(12) United States Patent
Distler et al.

(10) Patent No.: US 7,381,808 B2
(45) Date of Patent: Jun. 3, 2008

(54) METHOD AND NUCLEIC ACIDS FOR THE DIFFERENTIATION OF PROSTATE TUMORS

(75) Inventors: Juergen Distler, Berlin (DE); Fabian Model, Berlin (DE); Peter Adorjan, Berlin (DE)

(73) Assignee: Epigenomics AG, Berlin (DE)

( * ) Notice: Subject to any disclaimer, the term of this patent is extended or adjusted under 35 U.S.C. 154(b) by 0 days.

(21) Appl. No.: 10/172,086

(22) Filed: Jun. 13, 2002

(65) Prior Publication Data
US 2003/0113750 A1 Jun. 19, 2003

(30) Foreign Application Priority Data
Jun. 14, 2001 (DE) .............................. 101 28 508

(51) Int. Cl.
C12Q 1/68 (2006.01)
C07H 21/04 (2006.01)
(52) U.S. Cl. ................... 536/23.1; 536/24.3; 435/91.1; 435/91.2
(58) Field of Classification Search ............... 536/23.1, 536/24.3; 435/6, 287.2
See application file for complete search history.

(56) References Cited

U.S. PATENT DOCUMENTS

| 5,474,796 A | * | 12/1995 | Brennan ................ 427/2.13 |
| 6,017,704 A | * | 1/2000 | Herman et al. ............ 435/6 |
| 2001/0053519 A1 | * | 12/2001 | Fodor et al. .............. 435/6 |
| 2003/0036081 A1 | | 2/2003 | Adorjan et al. |
| 2003/0143606 A1 | * | 7/2003 | Olek et al. ............... 435/6 |

FOREIGN PATENT DOCUMENTS

| CA | 2359182 | 8/2000 |
| DE | 1990508 | 1/1999 |
| WO | 0070090 | 5/2000 |
| WO | WO 01/68911 A1 | 9/2001 |
| WO | WO 01/68912 A1 | 9/2001 |
| WO | WO 01/76451 A1 | 10/2001 |
| WO | WO 01/77164 A1 | 10/2001 |
| WO | WO 01/77375 A1 | 10/2001 |
| WO | WO 01/77376 A1 | 10/2001 |
| WO | WO 01/77377 A1 | 10/2001 |
| WO | WO 01/81622 A1 | 11/2001 |
| WO | WO 01/92565 A1 | 12/2001 |
| WO | WO 02/00705 A1 | 1/2002 |
| WO | WO 02/00928 A1 | 1/2002 |
| WO | WO 02/02808 A1 | 1/2002 |
| WO | WO 02/20806 A3 | 3/2002 |
| WO | WO 02/12554 A1 | 2/2002 |
| WO | WO 02/36604 A1 | 5/2002 |
| WO | WO 02/36814 A1 | 5/2002 |
| WO | WO 02/02808 | * 1/2007 |
| WO | WO 0200705 | * 1/2007 |

OTHER PUBLICATIONS

Takahashi et al. "H. sapiens gene coding for ACTH and beta-LPH precursors." Genbank Accession No. V01510, Jun. 1997.*
Dynal Technical Handbook. 3rd Edition. 1998, p. 174.*
Mahairas et al. (Genbank Accession No. AQ178776, Oct. 1998).*
Dynal (Biomagnetic Techniques in Molecular Biology, 1998).*
Takahashi et al. (Genbank Accession V01510, Jun. 1997).*
NCI-CGAP (Genbank Accession AI341269, Feb. 1999).*
Jones, P.A., (Jun. 1, 1996) "DNA Methylation Errors and Cancer", Cancer Research, vol. 56 pp. 2463-2467.
Chan, M.F., et al. (2000), "Relationship Between Transcription and DNA Methylation", Curr Top Microbiol Immunol., vol. 249 pp. 75-86.
Huang, T.H.-M., et al., (1999) "Methylation profiling of CpG islands in human breast cancer cells" Human Molecular Genetics, vol. 8, No. 3 pp. 459-470, Oxford University Press.
Rein, T., et al., (1998) "Identifying 5-methylcytosine and related modifications in DNA genomes", Nucleic Acids Research, vol. 26, No. 10 pp. 2255-2264, Oxford University Press.
Santourlidis, S., et al., (1999) "High Frequency of Alterations in DNA Methylation in Adenocarcinoma of the Prostate", The Prostate, vol. 39 pp. 166-174, Wiley-Liss, Inc.
Florl, A.R., et al., (1999) "DNA methylation and expression of Line-1 and HERV-K provirus sequences in urothelial and renal cell carcinomas", British Journal of Cancer, vol. 80, No. 9 pp. 1312-1321, Cancer Research Campaign.
Olek, A., et al., (1996) "A modified and improved method for bisulphite based cytosine methylation analysis", Nucleic Acids Research, vol. 15, No. 24 pp. 5064-5066.
Zeschnigk, M., et al., (1997) "A single-tube PCR test for the diagnosis of Angelman and Prader-Willi syndrome based on allelic methylation differences at the SNPRN locus", Eur J Hum Genetics, vol. 5, No. 2 pp. 94-98.
Olek, A., et al., (1997) "The pre-implantation ontogeny of the H19 methylation imprint", Nature Genetics, vol. 17, No. 3 pp. 275-276.
Gonzalgo, ML., et al., (1997) "Rapid quantitation of methylation differences at specific sites using methylation-sensitive single nucleotide primer extension (Ms-SNuPE)", Nucleic Acid Research, vol. 25, No. 12 pp. 2529-2531.
Xiong, Z., et al., (1997) "COBRA: a sensitive and quantitative DNA methylation assay", Nucleic Acids Research, vol. 25, No. 12 pp. 2532-2534.
Grigg, G., et al., (1994) "Sequencing 5-methylcytosin residues in genomic DNA", Bioessays, vol. 16, No. 6 pp. 431-436.

(Continued)

*Primary Examiner*—Jeanine A. Goldberg
(74) *Attorney, Agent, or Firm*—Barry L. Davison; Davis Wright Tremaine LLP

(57) ABSTRACT

The present invention relates to chemically modified genomic sequences, to oligonucleotides and/or PNA-oligomers for detecting the cytosine methylation state of genomic DNA, as well as to a method for ascertaining genetic and/or epigenetic parameters of genes for use in characterisation, classification, differentiation, diagnosis and therapy of prostate lesions.

16 Claims, 1 Drawing Sheet
(1 of 1 Drawing Sheet(s) Filed in Color)

OTHER PUBLICATIONS

Zeschnigk, M., et al., (1997) "Imprinting segments in the human genome: different DNA methylation patterns in the Prader-Willi/Angelman syndrome region as determined by the genomic sequencing method", Human Molecular Genetics, vol. 6, No. 3 pp. 387-395.

Feil, R., et al., (1994) "Methylation analysis on individual chromosomes: improved protocol for bisulphite genomic sequencing", Nucleic Acids Research, vol. 22, No. 4 pp. 695-696.

Martin, V., et al., (1995) "Genomic sequencing indicates a correlation between DNA hypomethylaton in the 5' region of the pS2 gene and its expression in the human breast cancer cell lines", Gene, vol. 157, pp. 261-264.

Eckhardt et al., DNA methylation profiling of human chromosomes 6, 20 and 22, Nature Genet. 38:1378-1385, 2006.

* cited by examiner

METHOD AND NUCLEIC ACIDS FOR THE DIFFERENTIATION OF PROSTATE TUMORS

FIELD OF THE INVENTION

The levels of observation that have been studied by the methodological developments of recent years in molecular biology, are the genes themselves, the translation of these genes into RNA, and the resulting proteins. The question of which gene is switched on at which point in the course of the development of an individual, and how the activation and inhibition of specific genes in specific cells and tissues are controlled is correlatable to the degree and character of the methylation of the genes or of the genome. In this respect, pathogenic conditions may manifest themselves in a changed methylation pattern of individual genes or of the genome.

The present invention relates to nucleic acids, oligonucleotides, PNA-oligomers, and to a method for characterisation, classification, differentiation, and/or diagnosis of prostate lesions, or the predisposition to prostate cancer, by analysis of the genetic and/or epigenetic parameters of genomic DNA and, in particular, with the cytosine methylation status thereof.

PRIOR ART

Prostate cancer is a significant health care problem in Western countries with an incidence of 180 per 100 000 in the U.S. in 1999 (Cancer J Clin 1999;49:8). Different screening strategies are employed to improve early detection, including determination of levels of prostate specific antigen and digital rectal examination. If a prostate carcinoma is suspected in a patient, diagnosis of cancer is confirmed or excluded by the histological and cytological analysis of biopsy samples for features associated with malignant transformation. Particularly early stages of prostate carcinoma are often difficult to distinguish from benign hyperplasia of the prostate by routine histological examination even if an adequate biopsy is obtained (McNeal J E et al., Hum Pathol 2001, 32:441-6). Furthermore, small or otherwise insufficient biopsy samples sometimes impede routine analysis.

Molecular markers offer the advantage that even samples of very small sizes and samples whose tissue architecture has not been maintained can be analyzed quite efficiently. Within the last decade numerous genes have been shown to be differentially expressed between benign hyperplastic prostate tumors and different grades of prostate cancer. However, no single marker has been shown to be sufficient for the distinction between the two lesions so far. High-dimensional mRNA based approaches have recently been shown to be able to provide a better means to distinguish between different tumor types and benign and malignant lesions. Application as a routine diagnostic tool in a clinical environment is however impeded by the extreme instability of mRNA, the rapidly occurring expression changes following certain triggers (e.g. sample collection), and, most importantly, the large amount of mRNA needed for analysis (Lipshutz, R. J. et al., Nature Genetics 21:20-24, 1999; Bowtell, D. D. L. Nature genetics suppl. 21:25-32, 1999), which often cannot be obtained from a routine biopsy.

Aberrant DNA methylation within CpG islands is common in human malignancies leading to abrogation or overexpression of a broad spectrum of genes (Jones, P. A. Cancer Res 65:2463-2467, 1996). Abnormal methylation has also been shown to occur in CpG rich regulatory elements in intronic and coding parts of genes for certain tumours (Chan, M. F., et al., Curr Top Microbiol Immunol 249:75-86,2000). Highly characteristic DNA methylation patterns could also be shown for breast cancer cell lines (Huang, T. H.-M., et al., Hum Mol Genet 8:459-470, 1999).

5-methylcytosine is the most frequent covalent base modification in the DNA of eukaryotic cells. It plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing since 5-methylcytosine has the same base pairing behavior as cytosine. Moreover, the epigenetic information carried by 5-methylcytosine is completely lost during PCR amplification.

A relatively new and currently the most frequently used method for analyzing DNA for 5-methylcytosine is based upon the specific reaction of bisulfite with cytosine which, upon subsequent alkaline hydrolysis, is converted to uracil which corresponds to thymidine in its base pairing behavior. However, 5-methylcytosine remains unmodified under these conditions. Consequently, the original DNA is converted in such a manner that methylcytosine, which originally could not be distinguished from cytosine by its hybridization behavior, can now be detected as the only remaining cytosine using "normal" molecular biological techniques, for example, by amplification and hybridization or sequencing. All of these techniques are based on base pairing which can now be fully exploited. In terms of sensitivity, the prior art is defined by a method which encloses the DNA to be analyzed in an agarose matrix, thus preventing the diffusion and renaturation of the DNA (bisulfite only reacts with single-stranded DNA), and which replaces all precipitation and purification steps with fast dialysis (Olek A, Oswald J, Walter J. A modified and improved method for bisulphite based cytosine methylation analysis. Nucleic Acids Res. Dec. 15, 1996; 24(24):5064-6, herein incorporated by reference). Using this method, it is possible to analyze individual cells, which illustrates the potential of the method. However, currently only individual regions of a length of up to approximately 3000 base pairs are analyzed, a global analysis of cells for thousands of possible methylation events is not possible. However, this method cannot reliably analyze very small fragments from small sample quantities either. These are lost through the matrix in spite of the diffusion protection.

An overview of the further known methods of detecting 5-methylcytosine may be gathered from the following review article: Rein, T., DePamphilis, M. L., Zorbas, H., Nucleic Acids Res. 1998, 26, 2255, herein incorporated by reference.

To date, barring few exceptions (e.g., Zeschnigk M, Lich C, Buiting K, Doerfler W, Horsthemke B. A single-tube PCR test for the diagnosis of Angelman and Prader-Willi syndrome based on allelic methylation differences at the SNRPN locus. Eur J Hum Genet. March-April 1997; 5(2): 94-8) the bisulfite technique is only used in research. Always, however, short, specific fragments of a known gene are amplified subsequent to a bisulfite treatment and either completely sequenced (Olek A, Walter J. The pre-implantation ontogeny of the H19 methylation imprint. Nat Genet. November 1997; 17(3):275-6) or individual cytosine positions are detected by a primer extension reaction (Gonzalgo M L, Jones P A. Rapid quantitation of methylation differences at specific sites using methylation-sensitive single nucleotide primer extension (Ms-SNuPE). Nucleic Acids Res. Jun. 15, 1997; 25(12):2529-31, WO 95/00669, herein incorporated by reference) or by enzymatic digestion (Xiong Z, Laird P W. COBRA: a sensitive and quantitative DNA methylation assay. Nucleic Acids Res. Jun. 15, 1997; 25(12): 2532-4, herein incorporated by reference). In addition, detection by hybridization has also been described (Olek et al., WO 99/28498, herein incorporated by reference).

Further publications dealing with the use of the bisulfite technique for methylation detection in individual genes are: Grigg G, Clark S. Sequencing 5-methylcytosine residues in genomic DNA. Bioessays. 1994 June;16(6):431-6, 431; Zeschnigk M, Schmitz B, Dittrich B, Buiting K, Horsthemke B, Doerfler W. Imprinted segments in the human genome: different DNA methylation patterns in the Prader-Willi/Angelman syndrome region as determined by the genomic sequencing method. Hum Mol Genet. March 1997; 6(3): 387-95; Feil R, Charlton J, Bird A P, Walter J, Reik W. Methylation analysis on individual chromosomes: improved protocol for bisulphite genomic sequencing. Nucleic Acids Res. Feb. 25, 1994; 22(4):695-6; Martin V, Ribieras S, Song-Wang X, Rio M C, Dante R. Genomic sequencing indicates a correlation between DNA hypomethylation in the 5' region of the pS2 gene and its expression in human breast cancer cell lines. Gene. May 19, 1995; 157(1-2):261-4; WO 97/46705, WO 95/15373 and WO 97/45560.

An overview of the Prior Art in oligomer array manufacturing can be gathered from a special edition of Nature Genetics (Nature Genetics Supplement, Volume 21, January 1999), published in January 1999, and from the literature cited therein.

Fluorescently labeled probes are often used for the scanning of immobilized DNA arrays. The simple attachment of Cy3 and Cy5 dyes to the 5'-OH of the specific probe are particularly suitable for fluorescence labels. The detection of the fluorescence of the hybridized probes may be carried out, for example via a confocal microscope. Cy3 and Cy5 dyes, besides many others, are commercially available.

Matrix Assisted Laser Desorption Ionization Mass Spectrometry (MALDI-TOF) is a very efficient development for the analysis of biomolecules (Karas M, Hillenkamp F. Laser desorption ionization of proteins with molecular masses exceeding 10,000 daltons. Anal Chem. Oct. 15, 1988; 60(20):2299-301). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones.

MALDI-TOF spectrometry is excellently suited to the analysis of peptides and proteins. The analysis of nucleic acids is somewhat more difficult (Gut I G, Beck S. DNA and Matrix Assisted Laser Desorption Ionization Mass Spectrometry. Current Innovations and Future Trends. 1995, 1; 147-57). The sensitivity to nucleic acids is approximately 100 times worse than to peptides and decreases disproportionally with increasing fragment size. For nucleic acids having a multiply negatively charged backbone, the ionization process via the matrix is considerably less efficient. In MALDI-TOF spectrometry, the selection of the matrix plays an eminently important role. For the desorption of peptides, several very efficient matrixes have been found which produce a very fine crystallization. There are now several responsive matrixes for DNA, however, the difference in sensitivity has not been reduced. The difference in sensitivity can be reduced by chemically modifying the DNA in such a manner that it becomes more similar to a peptide. Phosphorothioate nucleic acids in which the usual phosphates of the backbone are substituted with thiophosphates can be converted into a charge-neutral DNA using simple alkylation chemistry (Gut I G, Beck S. A procedure for selective DNA alkylation and detection by mass spectrometry. Nucleic Acids Res. Apr. 25, 1995; 23(8):1367-73). The coupling of a charge tag to this modified DNA results in an increase in sensitivity to the same level as that found for peptides. A further advantage of charge tagging is the increased stability of the analysis against impurities which make the detection of unmodified substrates considerably more difficult.

Genomic DNA is obtained from DNA of cell, tissue or other test samples using standard methods. This standard methodology is found in references such as Fritsch and Maniatis eds., Molecular Cloning: A Laboratory Manual, 1989.

DESCRIPTION

The disclosed invention provides a method and nucleic acids for the differentiation of prostate tumors. It discloses a means of distinguishing benign prostate hyperplasia from prostate carcinoma. This provides a means for the early detection and treatment of prostate cancer. Furthermore, the disclosed invention presents improvements over the state of the art in that current methods of prostate lesion differential diagnosis require the provision of a sample of sufficient size for histological and cytological examination. The method according to the present invention can be used for classification of minute samples.

The invention provides the chemically modified genomic DNA, as well as oligonucleotides and/or PNA-oligomers for detecting cytosine methylations, as well as a method which is particularly suitable for the classification, differentiation and/or diagnosis of prostate tumors, or the predisposition to prostate cancer. The present invention is based on the discovery that genetic and epigenetic parameters and, in particular, the cytosine methylation patterns of genomic DNA are particularly suitable for classification, differentiation and/or diagnosis of prostate tumors, in particular for use in differential diagnosis of prostate cancer.

This objective is achieved according to the present invention providing a nucleic acid containing a sequence of at least 18 bases in length of the chemically pretreated genomic DNA according to one of Seq. ID No.1 through Seq. ID No.112, and sequences complementary thereto.

The chemically modified nucleic acid could heretofore not be connected with the ascertainment of disease relevant genetic and epigenetic parameters.

The object of the present invention is further achieved by an oligonucleotide or oligomer for detecting the cytosine methylation state in chemically pretreated DNA, containing at least one base sequence having a length of at least 9 to 13 nucleotides which hybridizes to a chemically pretreated genomic DNA according to Seq. ID No.1 through Seq. ID No.112. The oligomer probes according to the present invention constitute important and effective tools which, for the first time, make it possible to ascertain specific genetic and epigenetic parameters of carcinomas, in particular, for use in differential diagnosis of prostate tumors and for diagnosis of predisposition to prostate carcinomas. The base sequence of the oligomers preferably contains at least one CpG dinucleotide. The probes may also exist in the form of a PNA (peptide nucleic acid) which has particularly preferred pairing properties. Particularly preferred are oligonucleotides according to the present invention in which the cytosine of the CpG dinucleotide is the $5^{th}$-$9^{th}$ nucleotide from the 5'-end of the 13-mer; in the case of PNA-oligomers, it is preferred for the cytosine of the CpG dinucleotide to be the $4^{th}$-$6^{th}$ nucleotide from the 5'-end of the 9-mer.

The oligomers according to the present invention are normally used in so called "sets" which contain at least one oligomer for each of the CpG dinucleotides of the sequences of Seq. ID No.1 through Seq. ID No.112. Preferred is a set which contains at least one oligomer for each of the CpG dinucleotides from one of Seq. ID No.1 through Seq. ID No.112.

Moreover, the present invention makes available a set of at least two oligonucleotides which can be used as so-called "primer oligonucleotides" for amplifying DNA sequences of one of Seq. ID No.1 through Seq. ID No.112, or segments thereof, for example using PCR.

In the case of the sets of oligonucleotides according to the present invention, it is preferred that at least one oligonucleotide is bound to a solid phase. It is further preferred that all the oligonucleotides of one set are bound to a solid phase.

The present invention moreover relates to a set of at least 10 n (oligonucleotides and/or PNA-oligomers) used for detecting the cytosine methylation state in chemically pretreated genomic DNA (Seq. ID No.1 through Seq. ID No.112). These probes enable classification, differentiation and/or diagnosis of genetic and epigenetic parameters of tumors, which are particularly useful in differential diagnosis of prostate cancer. Furthermore, the probes enable the diagnosis of predisposition to prostate cancer. The set of oligomers may also be used for detecting single nucleotide polymorphisms (SNPs) in chemically pretreated genomic DNA according to one of Seq. ID No.1 through Seq. ID No.112.

According to the present invention, it is preferred that an arrangement of different oligonucleotides and/or PNA-oligomers (a so-called "array") made available by the present invention is present in a manner that it is likewise bound to a solid phase. This array of different oligonucleotide- and/or PNA-oligomer sequences can be characterized in that it is arranged on the solid phase in the form of a rectangular or hexagonal lattice. The solid phase surface is preferably composed of silicon, glass, polystyrene, aluminum, steel, iron, copper, nickel, silver, or gold. However, nitrocellulose as well as plastics such as nylon which can exist in the form of pellets or also as resin matrices are possible as well.

Therefore, a further subject matter of the present invention is a method for manufacturing an array fixed to a carrier material for the classification, differentiation and/or diagnosis of prostate tumors, in particular, differential diagnosis of prostate cancer or for the classification, differentiation and/or diagnosis of prostate lesions or the predisposition to prostate carcinoma and/or for the therapy of prostate carcinoma, in which method at least one oligomer according to the present invention is coupled to a solid phase. Methods for manufacturing such arrays are known, for example, from U.S. Pat. No. 5,744,305 (herein incorporated by reference) by means of solid-phase chemistry and photolabile protecting groups.

A further subject matter of the present invention relates to a DNA chip for the classification, differentiation and/or diagnosis of prostate tumors, in particular, differential diagnosis of prostate cancer or for the classification, differentiation and/or diagnosis of prostate lesions or the predisposition to prostate carcinoma and/or for the therapy of prostate carcinoma. Furthermore the DNA chip enables the diagnosis of predisposition to prostate carcinomas. The DNA chip contains at least one nucleic acid according to the present invention. DNA chips are known, for example, for U.S. Pat. No. 5,837,832, incorporated herein by reference.

Moreover, a subject matter of the present invention is a kit which may be composed, for example, of a bisulfite-containing reagent, a set of primer oligonucleotides containing at least two oligonucleotides whose sequences in each case correspond or are complementary to an 18 base long segment of the base sequences specified in the appendix (Seq. ID No.1 through Seq. ID No.112), oligonucleotides and/or PNA-oligomers as well as instructions for carrying out and evaluating the described method. However, a kit along the lines of the present invention can also contain only part of the aforementioned components. Preferred is a kit, wherein the additional standard methylation assay reagents are standard reagents for performing a methylation assay from the group consisting of MS-SNuPE, COBRA, and combinations thereof.

The present invention also makes available a method for ascertaining genetic and/or epigenetic parameters of genomic DNA. The method is for use in the classification, differentiation and/or diagnosis of prostate tumors, in particular for the differential diagnosis of prostate cancer and diagnosis of predisposition to prostate cancer. The method enables the analysis of cytosine methylations and single nucleotide polymorphisms, including the following steps:

In the first step of the method the genomic DNA sample must be isolated (i.e. obtained) from tissue or cellular sources. Such sources may include cell lines, histological slides, body fluids, for example blood, sputum, faeces, urine, cerebrospinal fluid, lymphatic fluid tissue embedded in paraffin; for example, prostate or lymphatic tissue. Extraction may be by means that are standard to one skilled in the art, these include the use of detergent lysates, sonification and vortexing with glass beads. Once the nucleic acids have been extracted the genomic double stranded DNA is used in the analysis.

In a preferred embodiment the DNA may be cleaved prior to the chemical treatment, this may be any means standard in the state of the art, in particular with restriction endonucleases.

In the second step of the method, the genomic DNA sample is chemically treated in such a manner that cytosine bases which are unmethylated at the 5'-position are converted to uracil, thymine, or another base which is dissimilar to cytosine in terms of hybridization behavior. This will be herein understood as "chemical pretreatment".

The above described treatment of genomic DNA is preferably carried out with bisulfite (sulfite, disulfite) and subsequent alkaline hydrolysis which results in a conversion of non-methylated cytosine nucleobases to uracil or to another base which is dissimilar to cytosine in terms of base pairing behavior.

Fragments of the chemically pretreated DNA are amplified, using sets of primer oligonucleotides according to the present invention, and a, preferably heat-stable polymerase. Because of statistical and practical considerations, preferably more than ten different fragments having a length of 100-2000 base pairs are amplified. The amplification of several DNA segments can be carried out simultaneously in one and the same reaction vessel. Usually, the amplification is carried out by means of a polymerase chain reaction (PCR).

In a preferred embodiment of the method, the set of primer oligonucleotides includes at least two olignonucleotides whose sequences are each reverse complementary or identical to an at least 18 base-pair long segment of the base sequences specified in the appendix (Seq. ID No.1 through Seq. ID No.112). The primer oligonucleotides are preferably characterized in that they do not contain any CpG dinucleotides. In a particularly preferred embodiment of the method, the sequence of said primer oligonucleotides are designed so as to selectively anneal to and amplify, only the prostate specific DNA of interest, thereby minimizing the amplification of background or non relevant DNA, i.e. that the amplification step preferentially amplifies DNA which is of particularly interest in prostate cells, based on the specific genomic methylation status of prostate cells, as opposed to background DNA. In the context of the present invention, background DNA is taken to mean genomic DNA which does not have a relevant tissue specific methylation pattern, in this case the relevant tissue being prostate and prostate carcinoma tissue. Examples of such primers, used in Example 2, are contained in Table 1. The amplification of several DNA segments can be carried out in one reaction vessel using a polymerase is a heat-resistant DNA polymerase.

According to the present invention, it is preferred that at least one primer oligonucleotide is bonded to a solid phase during amplification. The different oligonucleotide and/or PNA-oligomer sequences can be arranged on a plane solid phase in the form of a rectangular or hexagonal lattice, the solid phase surface preferably being composed of silicon, glass, polystyrene, aluminium, steel, iron, copper, nickel, silver, or gold, it being possible for other materials such as nitrocellulose or plastics to be used as well.

In a next preferred step of the method, the methylation status of one or more cytosine positions is identified. This can be done in a number of ways that are generally known to the person skilled in the art. Some methods are described in more detail, below.

The fragments obtained by means of the amplification can carry a directly or indirectly detectable label. Preferred are labels in the form of fluorescence labels, radionuclides, or detachable molecule fragments having a typical mass which can be detected in a mass spectrometer, it being preferred that the fragments that are produced have a single positive or negative net charge for better detectability in the mass spectrometer. The detection may be carried out and visualized by means of matrix assisted laser desorption/ionization mass spectrometry (MALDI) or using electron spray mass spectrometry (ESI).

In a preferred embodiment, the amplificates obtained in the second step of the method are subsequently hybridized to an array or a set of oligonucleotides and/or PNA probes. In this context, the hybridization takes place in the manner described in the following. The set of probes used during the hybridization is preferably composed of at least 10 oligonucleotides or PNA-oligomers. In the process, the amplificates serve as probes which hybridize to oligonucleotides previously bonded to a solid phase. The non-hybridized fragments are subsequently removed. Said oligonucleotides contain at least one base sequence having a length of 13 nucleotides which is reverse complementary or identical to a segment of the base sequences specified in the appendix, the segment containing at least one CpG dinucleotide. The cytosine of the CpG dinucleotide is the $5^{th}$ to $9^{th}$ nucleotide from the 5'-end of the 13-mer. One oligonucleotide exists for each CpG dinucleotide. Said PNA-oligomers contain at least one base sequence having a length of 9 nucleotides which is reverse complementary or identical to a segment of the base sequences specified in the appendix, the segment containing at least one CpG dinucleotide. The cytosine of the CpG dinucleotide is the $4^{th}$ to $6^{th}$ nucleotide seen from the 5'-end of the 9-mer. Preferably one oligonucleotide exists for each CpG dinucleotide.

In the fifth step of the method, the non-hybridized amplificates are removed.

In the final step of the method, the hybridized amplificates are detected. In this context, it is preferred that labels attached to the amplificates are identifiable at each position of the solid phase at which an oligonucleotide sequence is located. In this final step, also an analysis of the methylation status of the cytosine positions by reference to one or more data sets can be present.

According to the present invention, it is preferred that the labels of the amplificates are fluorescence labels, radionuclides, or detachable molecule fragments having a typical mass which can be detected in a mass spectrometer. The mass spectrometer is preferred for the detection of the amplificates, fragments of the amplificates or of probes which are complementary to the amplificates, it being possible for the detection to be carried out and visualized by means of matrix assisted laser desorption/ionization mass spectrometry (MALDI) or using electron spray mass spectrometry (ESI). The produced fragments may have a single positive or negative net charge for better detectability in the mass spectrometer.

The aforementioned method is preferably used for ascertaining genetic and/or epigenetic parameters of genomic DNA.

The oligomers according to the present invention or arrays thereof as well as a kit according to the present invention are intended to be used for the classification, differentiation and/or diagnosis of prostate tumors. More preferably for the differential diagnosis of prostate tumors, or diagnosis of predisposition to prostate cancer. According to the present invention, the method is preferably used for classification, differentiation and/or diagnosis of important genetic and/or epigenetic parameters within genomic DNA, in particular for use in differential diagnosis of prostate tumors and predisposition to prostate cancer.

The method according to the present invention is used, for example, for classification, differentiation and/or diagnosis of prostate tumors.

The nucleic acids according to the present invention of Seq. ID No.1 through Seq. ID No.112 can be used for classification, differentiation and/or diagnosis of genetic and/or epigenetic parameters of genomic DNA, in particular for use in differential diagnosis of prostate tumors.

The present invention moreover relates to a method for manufacturing a diagnostic reagent and/or therapeutic agent for classification, differentiation and/or diagnosis of prostate tumours and cancer by analyzing methylation patterns of genomic DNA. More preferably for use in differential diagnosis of prostate tumors. The diagnostic reagent and/or therapeutic agent being characterized in that at least one nucleic acid according to the present invention (sequence IDs 1 through 112) is used for manufacturing it, preferably together with suitable additives and auxiliary agents.

A further subject matter of the present invention relates to a diagnostic reagent and/or therapeutic agent for prostate cancer by analyzing methylation patterns of genomic DNA, in particular for use in differential diagnosis of prostate tumors, or diagnosis of the predisposition to prostate cancer, the diagnostic reagent and/or therapeutic agent containing at least one nucleic acid according to the present invention (sequence IDs 1 through 112), preferably together with suitable additives and auxiliary agents.

The present invention moreover relates to the diagnosis and/or prognosis of events which are disadvantageous to patients or individuals in which important genetic and/or epigenetic parameters within genomic DNA, said parameters obtained by means of the present invention may be compared to another set of genetic and/or epigenetic parameters, the differences serving as the basis for a diagnosis and/or prognosis of events which are disadvantageous to patients or individuals.

In the context of the present invention the term "hybridization" is to be understood as a bond of an oligonucleotide to a completely complementary sequence along the lines of the Watson-Crick base pairings in the sample DNA, forming a duplex structure.

The term "functional variants" denotes all DNA sequences which are complementary to a DNA sequence, and which hybridize to the reference sequence under stringent conditions.

In the context of the present invention, "genetic parameters" are mutations and polymorphisms of genomic DNA and sequences further required for their regulation. To be designated as mutations are, in particular, insertions, deletions, point mutations, inversions and polymorphisms and, particularly preferred, SNPs (single nucleotide polymorphisms).

In the context of the present invention, "epigenetic parameters" are, in particular, cytosine methylations and further chemical modifications of DNA bases of genomic DNA and sequences further required for their regulation. Further epigenetic parameters include, for example, the acetylation of histones which, cannot be directly analyzed using the described method but which, in turn, correlates with the DNA methylation.

In the following, the present invention will be explained in greater detail on the basis of the sequences and examples with respect to the attached drawing without being limited thereto.

DESCRIPTION OF FIGURE

The patent or application file contains at least one drawing executed in color. Copies of this patent or patent application publication with color drawing(s) will be provided by the Office upon request and payment of the necessary fee.

FIG. 1 shows the separation of benign prostate hyperplasia (1) and prostate carcinoma (2). High probability of methylation corresponds to red, uncertainty to black and low probability to green. The labels on the left side of the plot are gene and CpG identifiers. The labels on the right side give the significance (p-value) of the difference between the means of the two groups. Each row corresponds to a single CpG and each column to the methylation levels of one sample. CpGs are ordered according to their contribution to the distinction to the differential diagnosis of the two lesions with increasing contribution from top to bottom.

Figure 1:
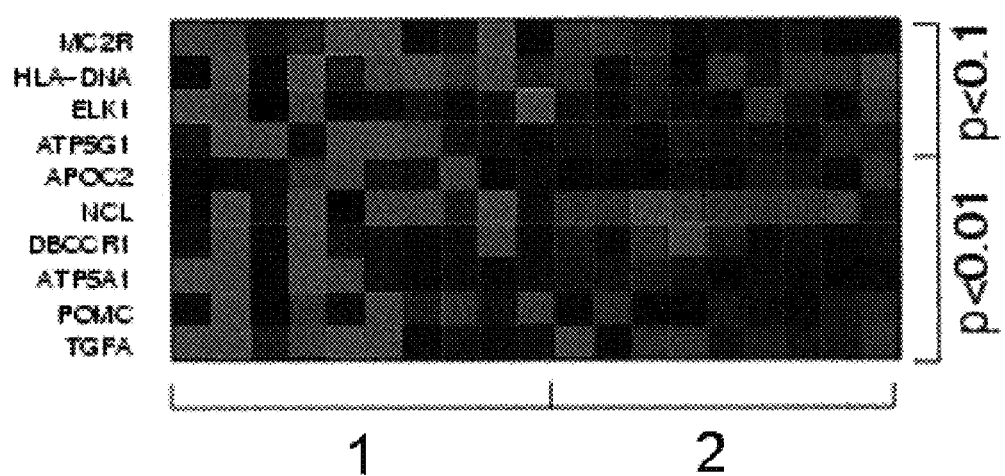
FIG. 1

Seq. ID No.1 trough Seq. ID No.112

Sequences having odd sequence numbers (e.g., Seq. ID No. 1, 3, 5, . . . ) exhibit in each case sequences of chemically pretreated genomic DNAs. Sequences having even sequence numbers (e.g., Seq. ID No. 2, 4, 6, . . . ) exhibit in each case the sequences of the chemically pretreated genomic DNAs which are complementary to the preceding sequences (e.g., the complementary sequence to Seq. ID No.1 is Seq. ID No.2, the complementary sequence to Seq. ID No.3 is Seq. ID No.4, etc.).

Seq. ID No.113 trough Seq. ID No.116

Seq. ID No.113 trough Seq. ID No.116 show sequences of oligonucleotides used in Example 1.

The following example relates to a fragment of a gene, in this case, TGF-alpha in which a specific CG-position is analyzed for its methylation status.

EXAMPLE 1

Methylation Analysis of the Gene TGF-alpha

The following example relates to a fragment of the gene TGF-alpha in which a specific CG-position is to be analyzed for methylation.

In the first step, a genomic sequence is treated using bisulfite (hydrogen sulfite, disulfite) in such a manner that all cytosines which are not methylated at the 5-position of the base are modified in such a manner that a different base is substituted with regard to the base pairing behavior while the cytosines methylated at the 5-position remain unchanged.

If bisulfite solution is used for the reaction, then an addition takes place at the non-methylated cytosine bases. Moreover, a denaturating reagent or solvent as well as a radical interceptor must be present. A subsequent alkaline hydrolysis then gives rise to the conversion of non-methylated cytosine nucleobases to uracil. The chemically converted DNA is then used for the detection of methylated cytosines. In the second method step, the treated DNA sample is diluted with water or an aqueous solution. Preferably, the DNA is subsequently desulfonated. In the third step of the method, the DNA sample is amplified in a polymerase chain reaction, preferably using a heat-resistant DNA polymerase. In the present case, cytosines of the gene TGF-alpha are analyzed. To this end, a defined fragment having a length of 531 bp is amplified with the specific primer oligonucleotides GGTTTGTTTGGGAGGTAAG (Sequence ID 113) and CCCCCTAAAAACACAAAA (Sequence ID No. 114). This amplificate serves as a sample which hybridizes to an oligonucleotide previously bound to a solid phase, forming a duplex structure, for example GTTTTTTTCGTTTTAGAG (Sequence ID No. 115), the cytosine to be detected being located at position 188 of the amplificate. The detection of the hybridization product is based on Cy3 and Cy5 fluorescently labelled primer oligonucleotides which have been used for the amplification. A hybridization reaction of the amplified DNA with the oligonucleotide takes place only if a methylated cytosine was present at this location in the bisulfite-treated DNA. Thus, the methylation status of the specific cytosine to be analyzed is inferred from the hybridization product.

In order to verify the methylation status of the position, a sample of the amplificate is further hybridized to another oligonucleotide previously bonded to a solid phase. Said olignonucleotide is identical to the oligonucleotide previously used to analyze the methylation status of the sample, with the exception of the position in question. At the position to be analysed said oligonucleotide comprises a thymine base as opposed to a cytosine base i.e GTTTTTTTTGTTTTAGAG (Sequence ID No. 116). Therefore, the hybridisation reaction only takes place if an unmethylated cytosine was present at the position to be analysed.

EXAMPLE 2

Differentiation of Prostate Tumors

In order to relate the methylation patterns to a specific tumour type, it is initially required to analyze the DNA methylation patterns of two groups of patients with alternative forms of a tumor, in this case one group of benign prostate hyperplasia and another group of prostate carcinoma. These analyses were carried out, analogously to Example 1. The results obtained in this manner are stored in a database and the CpG dinucleotides which are methylated differently between the two groups are identified. This can be carried out by determining individual CpG methylation rates as can be done, for example, by sequencing, which is a relatively imprecise method of quantifying methylation at a specific CpG, or else, in a very precise manner, by a methylation-sensitive "primer extension reaction". In a particularly preferred variant the methylation status of hundreds or thousands of CpGs may be analysed on an oligomer array. It is also possible for the patterns to be compared, for example, by clustering analyses which can be carried out, for example, by a computer.

All clinical specimens were obtained at time of surgery, i.e. in a routine clinical situation (Santourlidis, S., Prostate 39:166-174, 1999, Florl, A. R., Br. J. Cancer 80:1312-1321, 1999). A panel of genomic fragments from 56 different genes (listed in Table 1) were bisulphite treated according to Example 1 and amplified by PCR. The genomic DNA was amplified using the primer pairs listed in Table 1. However, as will be obvious to one skilled in the art, it is also possible to use other primers that amplify the genomic in an adequate manner, the design of such primers will be obvious to one skilled in the art. However the primer pairs as listed in Table 1 are particularly preferred. Optimal results were obtained by including at least 8 CpG dinucleotides, the most informative CpG positions for this discrimination being located within the TGF-alpha and POMC genes. Most other CpGs of the panel showed different methylation patterns between the two phenotypes, too. The results prove that methylation fingerprints are capable of providing differential diagnosis of solid malignant tumours and could therefore be applied in a large number clinical situations. FIG. 1 shows the application of the described method to distinguish benign prostate hyperplasia from prostate carcinoma.

TABLE 1

List of genes and primer oligonucleotides according to Example 2

| Name | Genbank Entry No. (internet address: ttp://www.ncbi.nlm.nih.gov) | Primer 1 | Primer 2 |
| --- | --- | --- | --- |
| ADCYAP1 | NM_001117 | GGTGGATTTATGGTTATTTTG | TCCCTCCCTTACCCTTCAAC |
| AFP | NM_001134 | AGGTTTATTGAATATTTAGG | AACATATTTCCACAACATCC |
| APOA1 | NM_000039 | GTTGGTGGTGGGGGAGGTAG | ACAACCAAAATCTAAACTAA |
| APOC2 | NM_000483 | ATGAGTAGAAGAGGTGATAT | CCCTAAATCCCTTTCTTACC |
| ATP5A1 | NM_004046 | AGTTTGTTTAATTTATTGATAGGA | AACAACATCTTTACAATTACTCC |
| ATP5G1 | NM_005175 | TGATAGTTTATGATTGTTGA | AATCTCAACCCTCAACTTCC |
| ATP6 | NC_001807 | GGGTATTAGGAATTTATGTG | CAAAACACCTTCCTAACTCA |
| C4B | NM_000592 | ATTGATAGGTAGTTAGATTGG | AAAAAACTCTCATAAATCTCA |
| c-abl | NM_007313 | GGTTGGGAGATTTAATTTATT | ACCAATCCAAACTTTTCCTT |
| CD1R3 | NM_001766 | ATTATGGTTGGAATTGTAAT | ACAAAAACAACAAACACCCC |
| CDC25A | NM_001789 | AGAAGTTGTTTATTGATTGG | AAAATTAAATCCAAACAAAC |
| CDH3 | NM_001793 | GTTTAGAAGTTTAAGATTAG | CAAAAACTCAACCTCTATCT |
| c-fos | NM_005252 | TTTTGAGTTTTAGAATTGTTTTTAG | AAAAACCCCCTACTCATCTACTA |

TABLE 1-continued

List of genes and primer oligonucleotides according to Example 2

| Name | Genbank Entry No. (internet address: ttp://www.ncbi.nlm.nih.gov) | Primer 1 | Primer 2 |
|---|---|---|---|
| c-MOS | NM_005372 | TTTATTGATTGGGAGTAGGT | CTAATTTTACAAACATCCTA |
| c-myc | NM_002467 | AAAGGTTTGGAGGTAGGAGT | TTCCTTTCCAAATCCTCTTT |
| CRIP1 | NM_001311 | TTTAGGTTTAGGGTTTAGTT | CCACTCCAAAACTAATATCA |
| CSF1 | NM_000757 | TAGGGTTTGGAGGGAAAG | AAAAATCACCCTAACCAAAC |
| CSNK2B | NM_001320 | GGGGAAATGGAGAAGTGTAA | CTACCAATCCCAAAATAACC |
| CTLA4 | NM_005214 | TTTTTATGGAGAGTAGTTGG | TAACTTTACTCACCAATTAC |
| DAD1 | NM_001344 | TTTTGTTGTTAGAGTAATTG | ACCTCAATTTCCCCATTCAC |
| DAPK1 | NM_004938 | ATTAATATTATGTAAAGTGA | CTTACAACCATTCACCCACA |
| DBCCR1 | NM_014618 | ATTTGGAGTTGAAGTATTTG | AACTATACCCAAACACCTAC |
| EGFR | NM_005228 | GGGTAGTGGGATATTTAGTTTTT | CCAACACTACCCCTCTAA |
| EGR4 | NM_001965 | AGGGGGATTGAGTGTTAAGT | CCCAAACATAAACACAAAAT |
| ELK1 | NM_005229 | AAGTGTTTTAGTTTTTAATGGGTA | CAAACCCAAAACTCACCTAT |
| ERBB2 | NM_004448 | GAGTGATATTTTTATTTTATGTTTGG | AAAACCCTAACTCAACTACTCAC |
| G6E | NM_024123 | AGGTTGGATTTTGGGTAGGT | TCTCCTACTCTCCTAATCTC |
| GP1BB | NM_000407 | GGTGATAGGAGAATAATGTTGG | TCTCCCAACTACAACCAAAC |
| HLA-DNA | NM_002119 | GAGGTTAAAGGAAGTTTTGGA | AAACTAAATTCTCCCAATACC |
| HLA-F | NM_018950 | TTGTTGTTTTAGGGGTTTTGG | TCCTTCCCATTCTCCAAATATC |
| MLH1 | NM_000249 | TTTAAGGTAAGAGAATAGGT | TTAACCCTACTCTTATAACC |
| HSPA2 | NM_021979 | AGAGGAGATATTTTTTATGG or AAGGATAATAATTTGTTGGG | AAAAATCCTACAACAACTTC or CTTAAATACAAACTTAATCC |
| IL13 | NM_002188 | TTTTTAGGGTAGGGGTTGT | CCTTATCCCCCATAACCA |
| l-myc | NM_005377 | AGGTTTGGGTTATTGAGTTT | CATTATTTCCTAACTACCTTATATCTC |
| MC2R | NM_000529 | ATATTTGATATGTTGGGTAG | ACCTACTACAAAAAATCATC |

TABLE 1-continued

List of genes and primer oligonucleotides according to Example 2

| Name | Genbank Entry No. (internet address: ttp://www.ncbi.nlm.nih.gov) | Primer 1 | Primer 2 |
|---|---|---|---|
| ME491/CD63 | NM_001780 | TGGGAGATATTTAGGATGTGA | CTCACCTAAACTTCCCAAA |
| MGMT | NM_002412 | TTGTGAGGTATTGGGAGTTAG | ACCCAAACACTCACCAAAT |
| MRP5 | NM_005688 | ATGAGGTGGGAGGATTGTTT | CATCCAAAATTCTAAACTAA |
| N33 | NM_006765 | TGGAGGAGATATTGTTTTGT | TTTTTCAAATCAAAACCCTACT |
| NCL | NM_005381 | AAGTTGTGTTTTAAAAGGGTTA | AAAAACTAAACCTACCCAATAA |
| NEU1 | NM_016215 | AGGAGGAAGGGTTAATAAAGA | ATCTTCCTACTACTATCTCTAAC |
| NF1 | NM_000267 | TTGGGAGAAAGGTTAGTTTT | ATCCAAACTCCCAATATTCC |
| n-myc | NM_005378 | GGAGGAGTATATTTTGGGTTT | ACAAACCCTACTCCTTACCTC |
| OAT | NM_000274 | TGGAGGTGGATTTAGAGGTA | ACCAAAACCCCAAAACAA |
| POMC | NM_000939 | AGTTTTTAAATAATGGGGAAAT | ACTCTTCTTCCCCTCCTTC |
| PGR | NM_000926 | AGTTGAAGTTATAAGGGGTG | AATAAAAACTCTCAAAAACC |
| RD | NM_002904 | AAGAGTGAGAAGTAGAGGGTT | CTACTCTCTAAAACTCCAAAC |
| SOD1 | NM_000454 | AGGGGAAGAAAAGGTAAGTT | CCCACTCTAACCCCAAACCA |
| TGFA | NM_003236 | GGTTTGTTTGGGAGGTAAG | CCCCCTAAAAACACAAAA |
| TGFB1 | NM_000660 | GGGGAGTAATATGGATTTGG | CCTTTACTAAACACCTCCCATA |
| TNF-beta | X02911 | TTTTTGTTTTTGATTGAAATAGTAG | AAAAACCCCAAAATAAACAA |
| TSP | NM_003246 | TGGTATTTTTGAGGTAGATG | CCCTATCTTCCTACACAAAC |
| UBB | NM_018955 | TTAAGTTATTTAGGTGGAGTTTA | ACCAAAATCCTACCAATCAC |
| UNG | NM_003362 | GTTGGGGTGTTTGAGGAA | CCTCTCCCCTCTAATTAAACA |
| VEGF | NM_003376 | TGGGTAATTTTTAGGTTGTGA | CCCCAAAAACAAATCACTC |
| WT1 | NM_000378 | AAAGGGAAATTAAGTGTTGT | TAACTACCCTCAACTTCCC |

SEQUENCE LISTING (239 sequences)

SEQ ID NO: 1 - DNA, 3953 bp, Artificial Sequence
  Chemically treated genomic DNA (Homo sapiens)
agtaggagggtaggagagaattttgtatagttggttacggtgttttatttaagggtttaatttggggttttattataaaagttgtagtaaaattgttaaaaataggaattattgggggtgggggttttgttttttttgtttagttattattttttttttttaatttttattttggtttatattacgtgtttttagaagaaacgttttgagtaggggttggtatgagattgtttttttttttaggatttatttttttttatgattaggttggtgattttttttttagggtgttagtgttatttattgagtagatgtttggtaggtgtttgttatgtgttagatttagtaggggatagagttttttcgatatagatggattagtatgtttggatataaattgtgaaaggagttgttaatttttttgtgtaaaatttatttttgcggttatcgttaatatttttatatatgttagggtatttagggttaggatttggtaattttgtttaggagtagtcgttttggagatttttaagacgagggaaagaaatgggtggaaataggggtttatattgtgggtttcgtagttattaaatagtttaattcgtggttattgagtgttttgaataatgtttggttggattttgagtttgagtgtgttattaatttagtttgttattgtcgttgttgttgttatgtatttttttattagttttgtttagaaagattttttttttttttaaaatattagtaaagggggtttagattagtttaagttaaatattttgtaataaaatggagtagttattttggtgaataagtatatttagaaaaggaaattgtttgtttggtaagatgttgtttaatagtattttttattttgatgtttcgtagtttttgagttaggaaattgagaagtttttgattagattgtaaaggttgtaggtttcgtaagggtgtaaggttatttttaaagaattagaagttaggtttttcgatttttatttttgttagcgttaaatagtaatcgttgaaggatgtagggtagttgtgagttgtagtttttttataggtaaaaattataagggtaaaatttggtttttagttttatagggatattttaagttgtgaaagtgttttggttataaagaattgcgtaaatgttaaatattaggtttagttataataattattttagtaataaattaaagagaagggtgaaatattggtaagtattttggagtttaattagtaagtttttgagatttttttatgtgttgattgggataaattttattttttaaaagaaaagacgtttttttggttcgagatatttgtgagttgttttagtaggggattagttatttttttattttttaaagttatagatagttgggatggttaagtaggtagtttaggttgatggtttattaaggttatttttttgtttatatagttttatagatatttggggttattttagttttagaaaagatgttttatattttagtaattgtaagttaaggataagtagagagatgtgggattgttgtttttatgtttgttgtagaagttgaggttttagatttgataaagtaagtgtagtgggaataagggaatatattattagaaattgggattttagaaaatagaatagttattgtttattaagtgttaggtatttttttaatagttttgtatatatgtttaaagtttatgtttaaaacgatataaatttattattttatagttatggaggatagaagtttaaaatgggttatattgggttaaaattatggtggtagtagagttgtgtttttggaggttgtagggaaaaatattttgttttttttagtttttagggaagggttgtttatgttttttagtttatggtttttttttagtagttacgagtttgatttttattgttatttttatatttttttttttgattttgaggttattgttttttttttgtataattaaggatttttgtgatgataatgggtttatttggagaatttaggttaattattttatttttaggtttttaattatattagtaaaatttttttttgttatggaaggtagtaaagttataggttttagggatgaggttgtggatatttttggggagcgttattttgtttgttatatagtaatttttgttataatttagggcgatggtatattttattattatttttaattagaaattgatgtgtggggaggtgatgtattataatttatttagggttaggtagttggatttgaatttgtttgatttttagatttgaggttttttggttttagaattttttttgaagtgaaaggtatgaggtcgattattttttgatttggtaaatagagatgttagtttggtttttagtgttagggagttttttggagtgatggtatagggtatatttttgttttgtattttaagtttagagattgggttttaggtttagttttttttttaattttttgagagatgatagtttttgggtaaagtttttttgtgttttttagtttttttatttgtgagatggtggtatggggagaggttggagtgatgttatagttttttttagtttgtattataggttttaggatttaggttttattagtaatttgttgggggaggtttgggttttttaggagaaatttgataagatggtgttgtaaatattaacggatatatagtattttatatttataggttgttttaggggtttttaataattttgattatttttgttttattttgtagatagaaaatcgaggtttagagagattatataatttgtttacgatttttttttagtaagatggaggttaagtgaaatgagaaagtaggttttttgttattttttttgtttagaggttttttttttatattagggttttttaagggttgagatttagttatatttgtgcgtgattaaatataagtgtgaataatgtaaagggagacgtttttaatttaaggggttttaattttgtaatgtaattttgagattatgtttttttttgttaaagttttttttttttgaagtgatggttattgtagatggtgagggttttttggaggcggataatatttttatatgataaaattaaaagttggtagtttcgaattgatttttggagtgttttgaaatgtaagaggttttcgaaattttagtttgggagttacggagggtttttttttttttttaggtttattagtttgggaggtttggagagaggtttggaggatttgttggggattaaagaagagtattggtgggaggatagggcgggggaagggggaggggagtgaagtagtttttttggaatgttggtggtgggggaggtagtttttttggtggaggagttttagcgttttttttttttttttttttgttaatataatggataatggtaattgtttatatatttttatggaggggaaggggatgagtgtagggaatttcgattttattcgggagatttgtaagtttgtagatatttttttttcgtttttattgaatttttgatttttgttttgtagttttcgtagtttgttgtttgtttattttatttgtttagttttagggatagagttgatttttgaatttttaagttttatattgttaggattagtgagtagtaatagggtcggggttgggtttattagttttttagtttagattttggttgtagatataaataggttttgtaagagttggttgtttagagattgcgagaaggaggtgcgttttgttgtttgtttcggttattttggttttttagtttaaggtttaggttttgttttaggtcgggtttttgggtatttgaggttttttttcgttttgtgtttttttttttatttggttgtaatgagtgggggagtacggggtttttgtatgttgaaggtattttatttagttaggtttttttttttttttagg

SEQ ID NO: 2 - DNA, 3953 bp, Artificial Sequence
  Chemically treated genomic DNA (Homo sapiens)
tttggaggagaagaagggtttggttgagtggggtgtttttagtatgtagaagtttcgtgtttttttatttattgtagttaggtgaggagaagggtatagagcgggagaagattttaggtatttagaggttcggtttggggtaaggtttgaattttgagttggggagttagagtgatcggggtaggtagtaggacgtatttttttttcgtagtttttaagtagttagtttttgtagggtttatttatgtttgtagttagggtttgggttgggaggttgataagtttagtttcggttttgttgttgtttattggttttggtaatgtggaatttaagagtttaaggattagttttgtttttggggttgggtaaatagagtgggtaaatagtaagttgcgggggttgtagggtaggggttaagggtttagtgggggcgggaggggagtgtttgtaggtttgtaggtttttcgggtggggtcggggttttttgtatttattttttttttttttatgggagtgtgtgggtagttgttattgtttattgtgttggtagaggaggggaggggagggacgttgggatttttttattaaggagattgttttttttattattagtattttagggagattattttattttttttttttttttttcgttttgtttttttattagtgtttttttttagtttttagtaggttttttaggtttttttttaagttttttaaattggtaaatttggggagaggggagagtttttcgtggtttttagattgaggtttcggagattttttgtattttaaaatattttagagattaattcggagttgttaatttttaattttgttatgtaaagatattgttcgtttttaaaaaatttttattatttatagtgattattattttaaaaaggaaaggttttaataaaaaagggtataattttagaattatattatagaattgaagttttttagattgaagacgtttttttttgtattgtttatatttatatttgattacgtataggtgtgattggattttagtttttgggaagttttggtgtggggagaagatttttgggtaaaggaagtggtaggagatttgtttttttattttatttggtttttattttgttggaggaagatcgtgggtaagttatataatttttttgagtttcggttttttatttgtaaaatggggtaagaatggttagggttgttggaggtttttgagatagtttgtgaatgtaaagtgttgtgtgttcgttggtgtttgtagtattattttgttaggttttttttggaaggtttagattttttttagtaggttattgataggatttgagttttagagtttgtgatgtaggttgagaggaattgtgatattattttagtttttttttatgttattattttatagatgaagagattgaagagtatagagggattttgtttagaggttgttattttttagggagttagaagaaaggttggatttagaatttagtttttggatttgggatgtagggtagaaatgtattttgtattattattttaggaaattttttaatattagaaattaggttgatatttttgtttattagattagggagtggtcggttttatgttttttattttagagaagattttggagttagaaaattttaaatttaagggttaggtaggtttaaatttagttgtttgattttggatgagttatgatatattatttttttatatattagtttttgattgaagataatgatagaatatgttatcgttttgagttatggtaggggttattgtgtggtaagtagaataacgttttttaaagatgtttatagttttatttttggaatttgtggttttgttattttttatggtaaaaaaagattttgttagtgtgattaaggatttggagatggggtggttggtttggattttttaggtgggtttattgttattataggggtttttaattatataagagggaggtagtggttttagagttagagaaagagatgtgaggatggtagtggagattagattcgtgattgttggaagggggttatgagttgagggatatgagtaatttttttttagaagttggagaaggtaaagtatttttttttgtagtttttaggagtatagttttgttgttattatgattttagtttagtatgatttattttggatttttgttttttataattgtaagataataaatttgtatcgttttaagtatgaattttgaatatatatgtaaaattgttagaaaggtatttagtatttagtaaatagtaattattttgttttttagaattttagtttttggtaatgtatttttttatttttattatatttgttttattagatttgagattttagtttttgtagtaggtatgaaggtagtagttttatatttttttgtttgtttttgatttgtagttgttgagatatggaatattttttttaggattgaagtggttttagatgtttatgggattgtgtagatagggaggtggttttggtgagttattagtttgggttgtttatttgattattttagttgtttgtagttttagaaagtgggaaggtggttggttttttgttgggatagtttataggtgtttcgggttaagagagcgtttttttttttggggggtagagtttgttttagttagtatatgggggaattttagaagtttattggttggattttaagatatttgttagtgttttatttttttttttggtttgttattaaaatgattgttatggttaaatttagtatttaatatttgcgtagttttttgtggttaaagtatttttataatttagaatatttttataaggttggaggttagattttatttttgtgatttttgtttgtgggaaaattgtagtttatagttgttttgtattttttagcggttattatttagcgttggtaggggtgggaatcgggaggtttggtttttagttttttgagggtggttttgtatttttgcggagtttgtagtttttgtagtttgattagggattttttagttttttggtttagggattgcgaggtattaggatagggggtgttgttgaatagtattttattaagtaggtagtttttttttttaaatatatttatttattagggtggttattttattttattgtaaggtatttggtttaaattagtttaagttttttttattaatattttggaaaggaaggaggtttttttggatagagttgatggaaaaatatataataataataacgataataataaattgggttgatgatatatttagatttagggtttagttaggtattgtttaaggtatttagtggttacgggttggattgtttggtggttgcggggtttatagtgtaggtttttgtttttatttatttttttttttcgttttgggagtttttagagcgattgtttttgaatagggttattaagttttggttttggatgttttgatatgtgtaggagtgttggcggtgatcgtaagagtggattttgtatagaaagattagtaattttttttataatttatgtttaaatatattggtttatttgtatcgggaggattttgttttttgttaggtttggtatataatagatatttgttaaatatttgtttagtgaatggtattggtattttagagggagggttattagtttggttatagggaggagtgggttttgggaggggaggtagttttatattagtttttgtttagaacgttttttttgggagtacgtggtatgagttagaatgagagttagggaggggaggtggtgattgagtaggggagataggatttttatttttagtagtttttatttttggtaattttgttgtagtttttgtgatagagttttaagttagatttttgggtggggtatcgtagttagttatgtaagatttttttttgtttttttgtt

SEQ ID NO: 3 - DNA, 7432 bp, Artificial Sequence
  Chemically treated genomic DNA (Homo sapiens)
atttgaagttagagttatttagaggagaaagagttggaattgagaatttaaggaatgtttggaagtgatcgggttcgagtttatttaggaagaaatagaggttggagatatgagattgtgttgttatttttttttattaatttttgggttttattgaggttttattataagtttggttttgtagtttagtgattaggagaaattagatataagataataataatagtaatgattttttttttttttttgagacggagttttgttttttcgtttaggttggattgtagtggcgcgatttcggtttaatgtaagttttattttttaggtttacgttatttttttgttttagtttttcgagtagttaggattataggcgtttgttattacgtttggttaattttttatatttttagtagagatggggttttatcgtgttagttaagatggttttaattttttgatttcgtgattcgtttgtttcggttttttaaagtgttggggttataggtatgagttatcgcgtttggttaatagtaatgatttttgagtatttatattgttagtttttacggtaagagttttttttattttttgttttgttttgttttaagatagagttttgttttgttatttaggttggagtgtagtggtgtgatcgcggtttattgtagtttttatttttcgggtttaagttatttttttgttttagttttttaagtagttgggattataggtacgtattattatttttggttaatttttgtatttttagtagggatagggttttttattatgttggttaggttggttttaaatttttggttttatatgatttgtttatttcggttttttaaagtgttgggattataggcgtgagttattgcgtttttttttgtatttgtttaagtaatatattgaaatatgtattgtgttttttattttatggaggaggaaattgaggttagtaaatgaggttgttatgggaggtggagataggatttgaatttgttttagtgtaggaggtttaagagtttttgtttttttttagggtattgtgtgggagggtgagaaggagggaggtttatagaggtatgatttttgattgttattgttatttgggttttgttttttgaagtttttgttaagcggggaggtggtcgggggagggttttgttttgtgtagttttttttttttcggttcgtagagttgagtatagagggatagaggtacggaatttttagaaatgtttttttttagaaataggttttaggttttgtttgttttgtgtttttgcgtgttggttttggtttgtattgggggtgagaagaagtgggtggagggatgtggggtttatatttggtgggtgtgagtgtggttgtgtgttttgtggttttgtagttacgtgagatatgagtacggagtgtgtgcgttttatggcgtgcgtatgtatgtgcgtgtcggggagtgtgtgtgtcggtggttgagagtgaagtgtgaatgttatattggtataaattgggattatttgtgtgtgtgtacgtgcgtgcgtggaagtgggagtatgtagtcgtggtaaaaaagtgtatgtttgtgtgtatatgtgtatttgtgtgtatttgtttttttgtggggtatgtgtgtgtaaaatatttgagtgtgtggatatgtgtgagggggtgagtgtgtgttggtgtgtacgtttgtgttttgtatatgtatttttttttttttttttgagacggagttttattttgttatttaggttggagtgtagtggtagtagtggtgcgattttggtttattgtattattcgtttattcgttttaagggatttttttgttttagtttttagagtatttgggattatagatatacgttattatgtttggttattttttttttttgagacggagtttcgttttgttatttaggttggagtgtagtggcgtgattttggtttattgtaacgttcgtttttcgggtttacgttatttttttgttttagtttttcgagtagttgggattataggagtttattattacgtttggttaattttttgtatttttattagagacggggtttcgtcgtgttagttaggatggtttttatattttgatttcgtgattcgtttgtttcggttttttaaagtgttaggattataggcgtgagttattgcgtttggttaatgtttggttaatttttttatatttttggtagagatagggttttgttatgttgtttaggttggttttgaaattttgattttaggtgattcgttcgttttggttttttaaagtgttgggattataggtatgagttattacgttcggttatgtattttatgttaaaatgggattatattttagattagtattatttagtagaaatttaaatttttaatatagggttaggtacggtggtttatgtttgtaattttagtattttcggaggtcgaggcgggtggatcgtaaggttaggagatttgagattattttggttaatagatgggtaaaaatttatttttattaaaaatataaaaaattagttatgtatggtggtatgcgtttgtagttttagttattcgggaggttgaggtcggagaattatttgaattcgggaggtagaggttgtagtgagtcgagatcgcgttattgtattttaatttgggtgatagagcgagatttcgtttgaaaaaaaaaaaaaatttaatacgtatgtagataatgtgtaaggtattattttatgtgtatcgtatgtagtaatttttaatttttacgataattttgaggtagatattattatttcgttttataaaaggagaaatagttttggggagataggataagttatcggttaaggtatatagttagttatatgtggttttcgcgtgacggttggtttttgtaggcgaggttttgtttagatgcgtgggtagaaggtttggttcggaaagaggaattgatagtaaggttaagttaatgtttgtttttgggggtagaaagttattttttgttttttttttattgtttatagaggtagtttagatagggtgggggttataggagaacgaagggagaagggggtagtttttgggtagtaaaattaggtggtgaagggaggtattagaggatggtaattagagaggttattagaggggaattataggtagatagggtgataggagggattattgatataaggtgaagagatggtttagtcggacggggtggtttatatttgtaattttagtattttgggagttcgaggtgggtggattatttgaggttaggagttcgaggttttaatatggtaaaattttattttttttaaaaatataaaaattagtcgggtatgatggtagatgtttgtaatttttgttattcgggaggttgaggtaggaaaattgtttgaatttaggaggtggaggttgtaatgagacgagattatgatattgtattttattttgggtaatagagtaagagattgattttgttttataaaaaaaaagaaaaaagaaaaaaaaaaagagatggttgatggttaaagaggggttagcggttaggggatatataagggtaaaggtaggaggtaagaggattggtagggggttgtttttgggttatcgggagcgatataggatgagtatggagggaaagggagaaggggattttagggttttagtttatttaagttgttttttggttttatttagtatgttagttagaggtttaggaaggaattttgagttttttattaaagttaaagatgagtcgttggagtttggtgaggggtaggatgaaggagttgttggagatagtggtgaataggattagagacgggtggtaatggttttggtgagggtgtgttgggttgggtggtgggaggggatttttgggtttgagggaggaggggttggggtttggatttttgagttttagggaggaggaaagggtgggagtggggttgtgatttttaggtttgggaggagtggagggttagagttgagagtaggaatttttaggttatagagaggagcggataaatggggtagagaatatttggggagagttggggtttttattgtgatgtttttttttttgtaggagttcgagtatttttcggggttttatgtagatttattatgacgattatttgagggatttgggttcgtttattaaggtttggtttttcgaatttaaagatagttttttgaagaagatttatagtttgtgttttaggtttgtttgtggggataaggattagggttaaaatgtttataaaagttaggtgtggttgtggcgggtgtttgtagttttagttatttaggaggttgaggtaggatgatggtttgagtttaggagttcgagattagtttgggtaatatagcgagattttttgggggtaaaataaaaagaaaaaaaaaagtttatatttttttaataaataaagttttatttgtgtttttgtttggatttttttttagtgtggttagaaaaaaatttattttattgttttttaggaattaatgagtagaagaggtgatatttgatggggaaggaagagtagggaggtcgggaagggtattaaggaataatattttattgtgggtttgcggagaatgggggattttaaggcgtgttagttttaggagggtgagggtaggagcgtgggtggagttagtaggtttttatgatggtttttattgagagtttcgtttttgttttttataagttttgattttatttttagtgggtatttagtatttttaatttttttatagtttttaatttagtttttgtcggaggcgaatttttagagtgagggttttttgttatttgagagaaggttttttgtgacgtgattttgggggacgttattgttttttttgtttttatttatttttttcgtagttttgttggttaggattttggtttagataaaggatgggggttgtggttgtggagcggaagtgggttttaattattataaattttttttgtgttcgttcggagttggtgaggatagtttgttagagtttggtaagaaagggatttagggtgcggggataggggggcgttagtagggagagggtaaagatcgataaagtaggaattttaagaggtataatattagaagttcgtgttggaattatgattgtgtgtgtgtgtgtgtgtgtgtgtgtgtgtgtgtgtgtgtgtgagagagagagagagggagatggagtttcgttatgtagtttaggttagatttaaatttttgggtttaagtaatttttttgttttagtttttttagtagttgggattataggtgtattattatattttataaattatagaatttagaattgtagattatttgagtttttgtttagagttagggtggttgaggtggggaggattttttgagtttaggagtttgaggatgtagtgagttgtgattttgttatcgtgttttagtttgggtgatagagaaattttatttttaaaaaagagaaagaaaaagggataggtataatggtttatgtttgtaattttagtattttgggaggtcgaggcgggtggattatttgaggttaggagttcgatattagttttattagtatggtgaaatcgtatttatattaaaaatataaaaattggtcgggtgtggtagtatatgtttgtaattttagttattttagaggttgagataggagaattgtttgaatttaggaagcggaggttgtagtgagtttagatcgtgttattgtattttagtttgggtgatagagtaagatttagttttggcggaaaaaaagaatgaaaaaatttaaaaaattaaaaaagaattgtaggttgggcgtggtggtttatatttgtaatttaaacgttttgggaggttaaggtaaacggattatttgatgttaggagttggagattagtttggttaatatggtgaaatttcgtttttattaaaaatataaaaattagataggtatggtggtgtatgtttgtatttttagttatttaggaggttgaggtaggagaatcgttcgaattcggaagatagaggttgcggtgagttaaaattgcgttatcgtattttagtttgggcgagagaataagattttgttttggaaaaaaaaaaagaattgtagattatttgtttgtgtttttttttcggggattagattttattttttttttgtcgtatttttttattttttacgtgtggatgatgatattgtgttttgtgtatgtttttcgttattaaaagtgttttttttatagagtaggtgagaatttagtgaggagatgtagggatatgaggtttgatttagggtagagttttaaggtaatatatttgatttattgtaggtttttaatggtgtttgtagagtatttttttgtattgatttagttttagtaaagggtagaggttttgttgtgttttttgttgggtttagaattgtttaggtgtttaagaaagttttttaggttgggtttagtggtttatatttgtatttttagtattttggggaggtcgagatgggaggatcgtttgagtttaggagttttagattagtttgggtaataaaataagttttttatttttataaaagaataaaaattagtagttgggtatggtggtttatgtttgtaattttagtattttgggaggttaaggtaggtaaattatttgaggttaggagtttaagattagtttggttaatatggtgaaattttatttttattaaaaatataaaaattaggtggggtatagtggtttaagtttgtaattttagtattttgggaggttaaggtgggcggattacgaggttagaagttcgagattagtttggttagtatggtgaaattttatttttattaaaaatataaaatattagtcgggtatggtggtaggtgtttgtgattttagttttttgggaggttgaggtagaagaattgttagaattttggaggtagaggttgtagtgagtcgagaatacgttattgtattttagtttgggtgatagagcgagattttattttaaaaaatacgaaaataaaaattagtcgggtggtggcgggtgtttgtaattttagttattggggaggttgaggtaggagaattgtttgaatttgggaggtgggggttgtagtgagttaagattgtattattgtattttagtttgggtaatagagtgagattttattttaaaaaagaaaaaaataataattaaaatgttaaaattaggagtagaattatagaatgttggaaagtgaggtttaagaagggggttgtgtttaagtttatgtatgggaaatttgattgggatatcgagtttatatagagtaggattttagttttttttattagagtggggcgtgattataggaatagtcgtttttagttagtttgttatatgatatttttttaatgttttagg

SEQ ID NO: 4 - DNA, 7432 bp, Artificial Sequence
  Chemically treated genomic DNA (Homo sapiens)
tttggaatattgagggggtgttatgtggtaggttgattggaggcggttgtttttgtggttacgttttattttggtgggggggattgagattttgttttgtgtgagttcggtgttttagttaagttttttatgtatggatttggatatagttttttttttgggttttattttttaatattttgtgattttatttttgattttaatattttaattattattttttttttttttgagatggaattttattttgttgtttaggttggagtgtagtggtgtaattttggtttattgtaatttttattttttaggtttaagtaatttttttgttttagtttttttagtagttgggattataggtattcgttattattcggttgatttttgttttcgtattttttgagatggagtttcgttttgttatttaggttggagtgtagtggcgtgttttcggtttattgtaatttttgtttttagggttttagtaatttttttgttttagttttttaaggagttggaattataagtatttgttattatgttcggttaatattttgtatttttagtagagatggggttttattatgttggttaggttggtttcgaatttttgatttcgtgattcgtttattttggttttttaaagtgttaggattataggtttgagttattgtgttttatttgatttttgtatttttagtagagatggggttttattatgttggttaggttggttttgaatttttaattttaagtgatttgtttgttttggttttttaaagtgttggaattataggtatgagttattatgtttagttgttaatttttatttttttgtagagatgggagatttgttttgttgtttaggttggtttggaatttttgggtttaagcgatttttttatttcggtttttttagggtgttgggagtataggtgtgagttattgagtttagtttagaaggtttttttgagtatttaaatagttttgggtttagtagggaatatagtaaagtttttgttttttgttaaggttgagttagtgtagggaggtgttttgtagatattattaaggatttatagtagattaaatgtgttattttagggttttgttttaagttagattttatgtttttgtatttttttattgagtttttatttgttttatgagagaggtatttttggtgacgaagaatatgtatagggtataatattattatttatacgtaggagatgaggaagtacggtagaaagagggtgagatttgattttcggagaaagaatataagtaaatggtttataattttttttttttttttaagataaggttttgttttttcgtttaggttggagtgcgatggcgtaattttggtttatcgtaatttttgtttttcgggttcgagcgatttttttgttttagttttttgagtaattggaaatataagtatgtattattatgtttgtttaatttttgtatttttagtagagacggggttttattatgttggttaggttggtttttaatttttgatattaagtgattcgtttgttttggttttttaaagcgtttggattataagtgtaagttattacgtttagtttatagtttttttttagttttttaaatttttttatttttttttttcgttaagattgagttttgttttgttatttaggttagagtatagtggtacgatttgggtttattgtaattttcgttttttgggtttaagtaatttttttgttttagtttttggaatagttgggattataggtatatgttattatattcggttaatttttgtatttttagtatagatgcggttttattatgttggtaaggttggtgtcgaatttttgattttaagtgatttattcgtttcggttttttagagtgttgggattataggtatgagttattgtatttattttttttttttttttttttttagaaatggggtttttttgttatttaggttggaatacggtggtaagattatagtttattgtatttttaaatttttgggtttaagggattttttttattttagttattttaattttaagtagaagtttaaatagtttatagttttaaattttgtgatttgtggagtgtggtggtgtatttgtagttttagttattggggaggttgaggtaggaggattgtttgagtttaggagtttgagtttagtttgggttatatagcgagattttattttttttttttttttttttatatatatatatatatatatatatatatatatatatatatatagttatggttttaatacgggtttttaatattgtgttttttaaaatttttgttttatcgatttttgttttttttttgttgacgtttttttgttttcgtattttgagttttttttttattagattttggtaggttgtttttattagtttcggacgggtatagagaggatttatagtggttgagatttattttcgttttatagttataatttttattttttgtttaggttaaagttttggttaatagaattgcggagggggtgggtggggatagaaagggtaatgacgttttttaaggttacgttatagggaatttttttttaagtgatagggaatttttattttgagaattcgttttcgatagaggttgggttgggggttgtggaggggttggaggtgttgggtgtttattgggaatggagttagagtttgtaggagataagggcgaagtttttagtgagggttattatggggatttgttgattttatttacgtttttgtttttatttttttgaaattgatacgttttgaagttttttatttttcgtaagtttataatagggtgttattttttgatatttttttcgatttttttatttttttttttttattaggtgttattttttttatttattgatttttgggaggtagtggggtgggtttttttttggttatattggggaaggatttagatagggatataggtgagattttatttattggagaagtatgaatttttttttttttttttgttttatttttaagagatttcgttgtgttgtttaggttggtttcgaatttttgggtttaagttattattttattttagttttttgagtagttgggattataggtattcgttataattatatttggtttttatgaatattttaattttggtttttgtttttatagataagtttggggtataggttgtgggttttttttaagaggttgtttttggattcgaggaattaggttttggtgagcggatttaggttttttaggtggtcgttatagtaggtttgtatgaagtttcggaaggtgttcgggtttttataggagagaggatattatagtggaggttttagttttttttaggtgttttttgttttatttattcgtttttttttgtgatttaggagtttttgtttttagttttaattttttattttttttagatttaggggttatagttttatttttattttttttttttttttgagatttaggggtttaggttttagtttttttttttttagatttaggagtttttttttattatttagtttagtatatttttattagaattattgttattcgtttttggttttgtttattattgtttttagtagtttttttattttgttttttattaggttttagcgatttatttttagttttggtggggggtttagggtttttttttgggtttttggttggtatgttaggtggaattagagggtaatttgggtaggttgggattttagaatttttttttttttttttttttatgtttattttgtgtcgttttcggtggtttaggggtagttttttgttagtttttttgttttttgtttttatttttatgtgttttttgatcgttaatttttttttaattattagttattttttttttttttttttttttttttttttttatgagatagagttagttttttgttttgttgtttagggtggagtgtagtgttatgatttcgttttattgtaatttttattttttggatttaggtaatttttttgttttagtttttcgagtagtagggattataggtatttgttattatgttcggttaatttttgtatttttagaagagatggggttttgttatgttggggtttcgaatttttgattttaagtgatttatttatttcgggtttttaaaatgttgggattatagatgtgagttatttcgttcggttgggttatttttttattttgtgttagtagttttttttgttattttgtttgtttgtggtttttttttaatggtttttttaattgttattttttgatgtttttttttattatttgattttgttgtttaggaattattttttttttttttcgtttttttgtgatttttattttgtttgagttatttttgtggatagtggagggagagtaggaggtgattttttgtttttaggggtagatattggtttagttttgttgttagttttttttttcgggttagattttttatttacgtatttggataaagtttcgtttatagagattagtcgttacgcgggggttatatgtagttagttgtgtgttttggtcggtgatttattttgtttttttaggattgtttttttttttgtagaacggggtaataatatttattttagggttatcgtgagaattaagagttattatatacgatgtatatggaatggtgttttgtatattgtttatatacgtgttaaatttttttttttttttagacggagtttcgttttgttatttaggttggaatgtagtggcgcgatttcggtttattgtaatttttgtttttcgggtttaagtgatttttcggttttagtttttcgagtagttgggattataggcgtatgttattatgtatggttaattttttgtatttttagtagagatgggtttttatttatttgttagttaggatgattttaaattttttgattttgcgatttattcgtttcggttttcgaaagtgttgggattataggtatgagttatcgtgtttggttttgtattaaaaatttaaatttttattggataatgttgatttagaatatgattttattttaatataaagtatatggtcgggcgtggtggtttatgtttgtaattttagtattttgggaggttaaggcgggcggattatttgaggttaggattttaagattagtttgggtaatatggtaaaattttgtttttattaaaaatataaaaaaattagttaggtattggttaggcgtagtggtttacgtttataattttagtattttggaaggtcgaggtaggcggattacgaggttaggatatggagattattttggttaatacggcgaaatttcgtttttagtaaaaatataaaaaattagttaggcgtggtggtgggtttttgtagttttagttattcgggaggttgaggtaggagaatggcgtgaattcgggaggcggacgttgtagtgagttaagattacgttattgtattttagtttgggtaatagagcgagatttcgttttaaaaaaaaaaaatagttaggtatggtggcgtgtgtttgtagttttaaatattttgaagattgaggtaggagaattttttgaaacgggtaggcggatgatgtagtgagttaagatcgtattattgttattattgtattttagtttgggtgatagagtgagatttcgttttaaaaaaaaaaaaaaaaatgtatatgtaaaatatagacgtatatattagtatatatttatttttttatatatgtttatatatttaaatattttgtatatatatattttatagagagataggtgtatataaatatatatatgtatatagatatgtatttttttattacgattgtatatttttatttttacgtacgtacgtgtatatatatagatgattttagtttgtattaatgtgatatttatattttatttttagttatcgatatatatatttttcgatacgtatatgtatacgtacgttatgaaacgtatatatttcgtatttatgttttacgtggttatagagttataggatatatagttatatttatatttattaggtgtgggttttatatttttttatttatttttttttatttttaatgtaggttaggattagtacgtagaggtatagggtaggtagggtttggagtttgtttttgaggagggatatttttgggggtttcgtgtttttgtttttttgtgtttaattttgcgggtcgggggaggggaggttgtatagagtagggttttttttcggttattttttcgtttggtagagattttagagagtagggtttaggtgatagtggtaattagaggttatgtttttgtgggttttttttttttttatttttttatatagtgttttgagagaagatagaggtttttgagttttttgtattgaggtaggtttaaattttgtttttattttttatgatagttttatttgttggttttagtttttttttttataaagtgggaggtatagtatatattttagtatattatttgaataaatataaagaaaggcgtagtggtttacgtttgtaattttagtattttgggaggtcgaggtgggtagattatatgaggttaggagtttgagattaatttggttaatatggtgaaaaattttgtttttattaaaaatataaaaattagttagaagtagtgatgcgtgtttgtaattttagttatttgggaggttgaggtaggagaatggtttgaattcgggaagtgaaggttgtagtgagtcgcgattatattattgtattttagtttgggtgatagagtaagattttgttttgaaataaaataaaataaaaaatgaagaaagtttttatcgtggagattggtaatataggtgtttaaagattattgttgttggttaggcgcggtggtttatgtttgtaattttaatattttgggaggtcgaggtaggcggattacgaggttaggagattgagattattttggttaatacggtgaaattttatttttattaaaaatatgaaaaattagttaggcgtggtggtaggcgtttgtagttttagttattcgggaggttgaggtaggagaatggcgtgaatttgggaggtggagtttgtattgagtcgagatcgcgttattgtagtttagtttgggcgaaagagtaagatttcgttttagaaaaaaaaaaaagattattgttgttattattattttgtgtttaattttttttagttattgggttgtagggttaggtttgtggtagggttttaatagggtttaagggttgatgagaggaaatagtaatatagttttatgtttttagtttttgtttttttttaggtgggttcgagttcgattatttttaagtattttttgagtttttaattttaatttttttttttttgggtgattttggttttagat

SEQ ID NO: 5 - DNA, 9884 bp, Artificial Sequence
  Chemically treated genomic DNA (Homo sapiens)
tcgtttaggttggagtgtagagtgatatgattttggtttattgcgatttttaattttcgtttttaggtttaagtaatttttttgttttattttttttagtagttgggattataggtttgtgttagtatgtagggataatttttttatttttagtagaacggggggttttattacgttgattaggttggttttaaatttttgattttaagtgatttgtttgtttcggttttttaaagagttaggattataggtgtgagttaatatatttagtttaaaatgattttttttttaaaggaaatttattagtaagttaagtttatttattatttattttattttatttttagagatagggttttgttttttcgtttaagttggagtatagtggtgattatagtttattgtaattttgaatttttgggtttaagtaattttttcgttttagtttttttagtagttgggattataggcgtgtattattatatttagttaattttttgtattttttgtagaaagagggttttattatgttgtttaggttgtttttgaatttttggttttaagtgatgtttttatttgggttttttaaagtgttgggattataagtatgaggtattatatttagtttgttttgtttattttttttgttttaaatatatttttgttttggttggatgcggtgttttatatttatatttttagtattttgggaggtcgaggtaggtggattatttgaggttcggagtttaagattagtttgattaatatggtaaaattttatttttattaaaaatataaaaattagttaggtatggtggtacgtgtttgtaattttagttatttgggaggttgaggtaagagaattatttgaattttggaggtagagtttgtagtgagttgagattgagatattgttttttagtttgggcgatagattgagaatttattataaaaaataaaaaaaaataaaaattaaatatatttttgttttgtaattaaattttagataaattggtgtagttttttagtatggggtaaaaaaagttatttttatgttttttgtttatttttattattataaattttataaaatatttttgtaatttttttttttttttgagaggagttttgtgttgttgtttaggttggagtgtagttgagtaatttcggtttattgtaagtttcgtttttcgggtttacgttatttttttgttttagtttttcgagtagttgggattatacggggttcgttattatattcggttaattttttgtatttttagtagagatagtgttttattatgttagttaggatggtttcgattttttgatttcgtgattcgtttattttagttttttaacgtgttgggattataggtatgagttattatgttcggttttttttttttttttagatagaattttattgtgttgtttaagttggagtgtagtggttattgtaatttttattttttaggtttaagtgattttcgtgttttagttttttaaatagttgggattataggtatgtgttattatgtttagttaaagatggggtagggggtgtagggatttcgatatgttggttagatttattttgaatttttgattttaagtgattaatttgttttagttttttaaagtgttgggattataggtgtgagttattatgtcggttaattttgttgttattgttgttgttgttttgagatagttttatttttgtcgcgtatattgaagtgtagaggcgtaattttggtttattgtaatttttatttggtttattgtaatttttattttttggatttaagcgattttttttttttagttttttgagtagttggggttataggtgtgtattattatttttagttaatttttgattttttagtagagacggggttttgttatgttggttaggttggttttgaatttttgattttaggcgatttgtttgttttggttttttaatgtgttaggattatatgcgtgagttattatgttcggttttgttgtttttagaaacgatatttttttttgttagtttgtgaaagttgattgggttatttttgttatttttaattaaaatagtgttaagaggtaaagggaaaaaaaagtatttagggtatataatattgttttaaaaatgtaattatttgtaagtttggttgttgaaattgttcgttataatttaaattagtttttttgtttgtttgttttgagatggagttttattttgtcgtttaggttggaatgtaatggtatgattttggtttattgtaatttttgtttttaggtttatgtgatttttttgttttagttttttaagtagttgggattataggtattcgttaatatatttagttaatttttgtatttttagtagagacggggttttattatgttggttaggttggttttgaatttttgattttaggtgatttattcgtttcggttttttaaagcgttgggattataggcgtgagttatcgtgttcggttgatttaaattagttttatttaattagttgttaaaaataatttgtagtgattttaaggatcgttttatttagttgttattatttgttaattaaaatttgttagttttttaaaattttattagtgataatgaatttttttaaagaataatatataatagttttttttttttgttgtttgttttgatatagggttttgttttgttgtttaggttggagtgtttcggtgtgattatagtttattgtatttttaaatttttgggtttaagtgaattttttattttggttttttaacgtgttgggattataggtatgagttattgtttttggttatattttttttttataaaaataaaatttttaattatttgtttgtttttttgacgtattaaagattattttgtttgtgtgtatgttttgaatggtaattattgttttttaaatgttttaaatttatagatttgtttttgtattttattttatttggatagttttttttttttttttttttttttttttttttttttttttttttttttttttagatggagttttatttttattgtttaggttggaggatagtggtgtaatttggggtttattgtaatttttgtttttcgggttaaagtaatttttttgttttagtttttttagtagttgggattataggtgttcgtttttatgtcgggttaatttttgtatttttagtagagatggggttttgttatgttggttaagttggtttcgaatttttgattttaggtgatttattcgttttagttttttaaagtgttgggattataggcgtgagttattgcgtttggtttggatagtttttttgtatttttgatttttaggagaattgttgttttatttttttatggtttattttgaaaagagtaggatattagagaaaaggatggttaattacgtgtttataagttatgttttaggagatgatttttgtagttcggatatttatttgttttattaaaatttaggttttaggtgtaagttaggatttgggggatggaattgaaaatgtttttttaaacggtgaaaagcgggtttagcgtagaggttgaggaggaaggattatttgaagttaggagttcgagattagtttgggtaatatagagagatttttttttacgttttgtttattatcgtcgtttttataaaaaaattagttaggtatggtggtgggattataggggtataggttgaggttagaggattgttttagtttaggagttttaggttgtaatgaatggtgataaatttattgtatttttttttgggtaatagagtgagattttgttttaaataaaataaaataaataaataaaaaaaaaagaaaagtgaaggtaacgttaataagtgtttattatgatataataatattagtattatatatatatattaattttgtatatattattaaaattttagtatggtaattttgtggagaaaaaaaaaaagtttatttaggtaagtatagaaagtgtttttttattatttttttttgattttaaatgaagaagtagagtttttaatagtatgaattagatgttggtagaggaaaaagcgagttttcgttttattttggtgtaaatttttgattttggataatttttagtaggattggtaatgatttttttaggtttttttgtgattgttgatatattttttttaatttaaagtttcggaatatatgtttaggacgtgtaggtttgttatataggtaaatgtgtgttatggtggtttgttgtaattattattttattatttaggtattaagtttcgtatgtattagttatttattttgatgtttttttttttcggttattaggatttttaaatagtttgttttaatttattgataggatttttttagaatgaatttaaaaaagttgggaatttttaatttgagcgtagatcggattacgtggaacggtgttggtgtttgttaaaaatttagattgtttcgaattttcgatttagagggtttgaagtggggttaagatttgtagattaacgggtttcgtgggaggttttttgttggtggttagtttcggggtttagttgtttattgttgttattcgtgttaaattacggtttaatattatcgatattattaatcgttttggtttttaagatagtcgcgattttagacgggtgaggtttttattttttagtattagatggggtttgggaattgttgtttagtagatttagttatttacgtggttattcggggtaattataaggtcgatttaaaagattaaaataaatgtataacgaatgttaggattaaagtcggaatatatttaattatttattttgaggtttaaatttaaaaatgttatataaaaaaataagtaatttgttaaaaaatgtagagtggcggcgggggcggggggagaggtggtgaacgcgaggggtagtattttcgggttaggtgggtcggttgttttgattttttttgcggttcggttattttgttttagttagttcggaggttgcggttgtagaagtatcgtttgcggagtaattgtaaagatgttgttcgtgcgcgttgttgcggtcgtggttcgcgttttttttcggcgggtcggattggtgagtatcgaaggtcggtatgatgtaggcggtcgggtggggttgtagggtggtggtgcgtcggttcgggcgttttttgtaggagggcgaggggttgtggcgaatgtcgttattttgtattcgtggttttttcggttggatagagtaggcgatataggtgtttttttgttcgttatttgcgtagaggtagaatggtatagggtagatagttaattcgatggtgtttagagatagggttttaagatttttgttttcggttgatagcggttttagaagggggattttgggtgaaggttagggtttgggcgttagtttttcgaggtttgttttgaatcggtgaggtttttttttttcgatttttagggtcgcgtttcgttgaaggttagaaaattgttgttagtttttgttgaagttagttagtggagtttgatattgtgtgaaggttagtaggtttagtattttatttttgtttggagtttagtttagaggaaaggaataaatgaaggtggtttttggaatatttacgtaggtttttttttagtgttgaatacgaaacgatcgtgaaaacgttttgtaggtgtaaagaattattttatgtggttagtattgtgataatagtgaagttggtttttaaattgttttttcggtagagtgtgtgttttgtggtatttggacgtgtttaaagaatttgtttttgagttttttatttggttttgagtaatttttagtgatggagaatttaagtaaaagagaataaggttggaaaatggttgtaaggattaatatttttcgttatttgttttttttgaaattaatatgattttagtgtaaacgtattgatattgatattttttttttgttttaaaagtaattttaatttgaaaggtgaaataaatatgttggttgttttgttgttttaataatcgttggtagtattttgggtttttgttaataaaaaagtatttttaacggtttttatttagtttttatggaaggtagaggttttagaattgatagtgattagtcgtagtattataatttgaaggagaaattgaaggaagttttaggtggttgtaggatttgttgagagagtaaaataagtttatatgttttaatttttggtttttaatttaattttagtatttatttagtttttgtttgtttggtttttttttttttttttttttttgagatggtgtttcgtttagtcgtttaggttggattgtaatggcgtgattttcgtttattgtaattatcgttttttaggattaagtgatttttttattttagtttttcgagtagttgggattataggtattcgtcgttatgttttgttattttttgtagtttttcgtagagacggggttttattatgttggttaggttggttttgaatttttgacgttaggtgattcgttcgtttcggttttttgaagtgttgggattataagtatgagtcgtcgtgttcggtcgtttgttgtcgttgttgttgttgttgtttttaagtaaaattggaattattttgagttttgttttttgtaggaagttgtttattttagaatttttgtaattttattaaaatatatttaaagttaaaataataaaaattgggtattttaaagggaaagatatttatattttgttaatagtggggggggggggttttcggggttttaggttttttttttttttttttttcggggttttaaaaaggaatttttttttaaaaaaaaaaaaaaaaaaaaaaaaagaaagaaaaagaaagaagaaaaaaagaaaagaaaaaagaaattagagtagttggtgaaagtttatttattttttgtataaataggatttagtttggttgtaagtaatagaaaattttaaaataatagtggtttagataaggaagaggtttattttttttttatttataagtttttgattggttattttagggttggtatggttgtttttggggtgaggatttatatttttgtttgtttattttagtggtgtttggtttaatgtttggtatatgatagatttttagtaatatttattgaatgattgaaaaaattattaattaatagaaggatattgaaaaatttttgatatgtagaattaggatgattttttaaagagtgggtttatttttagtgtttttaatagtatgtgcggatgttagttttattttgttagttatagttattgtttttttttttgtttatttaataagtaaaatttggtgttttatttaatttttatttgcgtttttattattagggagagtgtatatttggttatttttttgtaattttttttttataaatggttttgtttttttttttatgttttgtttgtaaatttatatgtatattttaaaatatatatttttgtatatatatacgtgtgtgtgtgtgtgtgtgtgtgtgtaatttatatgttttaatatttagtataggtatgatatagtgagaggtagtttttaggtttttaagtttttgtattggatattttcgggtttgatttttagtttggttttttttaagttaaagaatgtgtgtgttcgtgtttaaattatttagttttttttagttttgtttttttatttgtaaaatgatatatgtatatggattttgaaaatattttatatagttaagtttattgatttaaagttttgtgattttttttattatatttcgaggttttttgtggtttaagttttatttaatatgtgttttatgattgggcgttgtggtttatgtttataattttagtattttgggaggtcgaggtgggataattgtttgagtttaggggtttaagattagtttgggtaatatattgagattttgtttttataaaaaaaattttaaaattagtaaggtatggtggttagtatttgtagttttagataattaggaggttgaggtagaaggattatttgagtttatgcggttgaagttgtagcgagtcgtgattatattattgtattgtaatttggatgatagagtaagacgttgttttattaaaaatattgttttttgagtatgagggtttaagtgttttgatatttgtagaagttagagatttgtgtggatttgtaaaatgaggaggaggtggatttttgtttttagggttttatattttttttaaggaagtaaataaagatgtaggatattaatgggaaatagattgatttatttttttttaggttaaaaagagtggtttatttgtcgggatggtggtttttgtttgtaattttagtattttgggaggttaaggtaggtggattacgaggttaggagattgagatttttttggttaatacggtgaaaatttcgtttttattataaagtagaaaaaaattagttcggtgtggtggtatgtgtttgtagttttagttatttaggaggagaattgtttgaatttgggaggtagaggttgtagtgagtcgagattgtattattgtattttagtttgggtgatagagcgagatttcgttttttaaaaaaaaaaaagtggtttattggggtaagtttttttttttttttttttttttttttttttttagtagagatggggttttattatgttggttaggttggtttttaatttttgattttatatgatttattcgttttggttttttaaagtgttgggattataggtatgagttatcgtgttttgttaatagttgttttttaaaatattgattgttaggtcgggtgtagtggttgacgtttgtaattttagtattttgggaggttaaggtgggtgtattatttgaagttaggagttcgagattaatttggttaatatggcgaaattttgtttttattaaaaataaaaaaattagtcgggtatggtggtggtcgtttgtagttttagttatttaggaggtcgaggtatgagaatcgtttgaatttgggaggtgaaggttgtaatgagttaagatcgtgtttttgtattttagtttgggtgatagaatgagatttcgttttagaaggaaaaaaaaaatgtgtgtgtatatatatatttattgtttagtaaatatatatttatttattgtttagtttgggtaatatgatgaaattttgtttttataaaaaaaataagtataaaaattagtttggttaggtggcgtatttttgtgattttatttattggggaggttgaggtgggaggattatttgagtttaggaagtcgaggttgtagtgagtcgtgattgagttattgtatttcgatttgggtgataagagtgagattttgttttaaaaaagaaaaaaaaataagtcgggtgcggtgtttacgtttatagttttagtattttgggaggttaaggcgggtggattatttgaggttaggagttcgagattagtttggttagtatggtgaaatttcgtttttattaaaaatataaaaaattaatttggtggaggtggcgtatttttgtagttttagttattcgggaggttgagaatcgtttgagattaggaggtggaggatgtagtgagtcgttttaaaaaaataataataataaagtatagattgtattttaaaaatatgcgagtgtttattgtgtattaggagttgtataaaaggtttttatatatattaaaagttatttttttatttgatattttaaataaaatgttttatatgtaattagtatttttattagtattttgattatattaagttggtatttgtttaagtttgtaagttttataaaggttttgttaaaaattaaatttttaagaatatttttgtattagg

SEQ ID NO: 6 - DNA, 9884 bp, Artificial Sequence
  Chemically treated genomic DNA (Homo sapiens)
tttagtgtaaaagtatttttaaaaatttgatttttaataaagtttttataaaatttataagtttaaataaatgttagtttagtgtgattaaagtattggtgaaaatgttaattatatataaagtattttgtttaaaatgttaaatgggaaagtagtttttgatatatgtgaaaattttttatatagtttttagtatatagtaaatattcgtatatttttaaaatgtagtttgtattttattattattgtttttttgagacggtttattgtattttttattttttagttttaagcgatttttagtttttcgagtagttgggattataggggtgcgttatttttattaggttaattttttatatttttagtagagacggggttttattatgttggttaggttggtttcgaatttttgattttaagtgatttattcgttttggttttttaaagtgttagaattataggcgtgagtatcgtattcggtttattttttttttttttttgggatagggttttatttttgttatttaggtcggagtgtagtggtttaattacggtttattatagtttcgattttttgggtttaggtgatttttttattttagtttttttagtaggtgggattataggagtgcgttatttggttaggttaatttttgtatttattttttttatagagataggattttattatattgtttagattgggtagtaaataaatatatatttattgggtagtaaatatatatatatatatatattttttttttttttttgagacggagttttattttgttatttaagttggagtgtaggggtacgattttggtttattgtaatttttattttttaggtttaagcgatttttatgtttcggttttttgagtagttgggattataggcgattattattatgttcggttaatttttttatttttagtagagatagggtttcgttatgttggttaggttgatttcgaatttttgattttaggtgatgtatttattttggttttttaaagtgttggaattatagacgttagttattgtattcggtttggtagttagtattttaaaaagtaattattggtagggtacggtggtttatgtttgtaattttagtattttgggaggttaaggcgggtggattatgtgaggttaggagttggagattagtttggttaatatggtgaaattttatttttattaaaaagaaaaagaaaaagaaaaagaaaaagaaatttgttttagtaaattatttttttttttttgggaaacggagtttcgttttgttatttaggttggagtgtagtggtgtagtttcggtttattgtaatttttgttttttaggtttaagtaattttttttttgagtagttgggattataggtatatgttattatatcgggttaatttttttttattttatagtagagacggggtttttatcgtgttagttaggaaggttttaattttttgatttcgtgatttatttgttttggttttttaaagtgttgggattataggtaggagttattatttcggtaggtaaattattttttttagtttgaaggagagtaggttagtttgttttttattagtgttttatatttttgtttgtttttttaagaagaatgtaggattttgagggtaggaatttattttttttttattttgtaggtttatataggtttttgatttttgtaaatgttagaatatttaagtttttatatttaaaagatagtatttttagtgagatagcgttttgttttgttatttaggttgtagtgtagtggtgtaattacggttcgttgtagttttaatcgtatggatttaagtgatttttttgttttagttttttgattatttgggattgtaggtattggttattatgttttgttaattttaaaattttttttgtagagatagggttttaatatgttgtttaggttggttttgaatttttggatttaagtaattgttttatttcggttttttaaagtattaggattataggtatgagttatagcgtttaattataagatatatattgagtaaaatttggattatagaaaatttcgaagtgtaatagaagaaattataaaattttagattaataaatttgattgtataaagtgtttttaaaatttatatatatatattattttatagatgaggaggtaaagttgaggaaagttgaataatttgaatacgggtatatatattttttggtttgaaaggagttaaattgggaattaaattcgggaatgtttagtgtaaaagtttgagggtttgaggattgttttttattgtgttatgtttatattggatgttagaatatgtgaattatatatatatatatatatatatatacgtgtatatatataaaaatatatattttaaaatatgtatataaatttataagtaaagtatgaggaagaaaataaaattatttgtaaaagaggaattataagaaaataattaaatgtgtattttttttggtgataaaaacgtaaatgaaagttgaataaggtattaagttttgtttattgaatgagtagaaaaaaagataatagttatgattgatagagtgaaattagtattcgtatatattattgggaatattgagaataggtttattttttaggaaattattttggttttatatattaaaagttttttaatgtttttttgttagttaatggtttttttagttatttagtaggtattattgagaatttgttatgtgttaggtattgaattaggtattattggagtaagtagataggagtgtgggtttttattttaagggtagttatgttagttttggaatgattaattaggggtttgtagatgagagagaaataaattttttttttgtttaggttattgttgttttggggttttttattatttgtagttaaattgaattttatttatatagaaggtaagtgagtttttattagttgttttggttttttttttttttttttttttttttttttttttttttttttttttttttttttttttttttttttgaaaaaaaatttttttttggggtttcggggggggggggggggggggatttggggtttcgggaattttttttttttattgttaataaaatgtaagtgtttttttttttaaggtatttaatttttattattttgattttagatgtattttaatggagttgtaggaattttaagataaatagttttttataaggggtaaaatttaaagtagttttaattttatttaaaaataataataataataacgataataagcggtcgggtacgacggtttatgtttgtaattttagtattttagaaggtcgaggcgagcggattatttgacgttaggagtttaagattagtttagttaatatggtgaaatttcgtttttacgaaaaattataaaaagtagtagggtatgacggcgggtgtttgtaattttagttattcgggaggttgaggtgggagaattatttgattttgggaggcggtggttgtagtgggcggagattacgttattgtaatttagtttgggcgattgagcgagatattattttaaaaaaaaaaaaaaaaaaaaaaattaggtaaataaaaattgaataaatgttagagttagattagaaattaagagttggggtatgtggatttattttatttttttaataaattttgtagttatttggaattttttttagttttttttttaagttgtaatattgcgattggttattgttaattttgaagtttttattttttataggagttagatgaaaatcgttaaaaatgtttttttgttaatagaaatttaagatgttattagcggttgttaaggtagtaaaatagttaatatgtttattttattttttaaattgagattatttttagaataaaaaaaaagtgttagtgttaatgcgtttatattgaaattatgttaattttaagggaaataaataacgaagggtattaatttttatagttattttttaattttgtttttttttatttgaattttttattattaaaaattatttaaaattaggtggaaaatttaaggataaattttttaaatacgtttaagtgttataaagtatatattttgtcggagagataatttagaaattagttttattgttgttatagtgttggttatatgaaatggttttttgtatttgtaggacgtttttacggtcgtttcgtatttagtattaagagaaagtttacgtaagtattttaaaaattatttttatttattttttttttttaaattgagttttaggtagaggtgaaatgttgggtttgttgatttttatataatgttagattttattgattagttttaataagagttgatagtagttttttgatttttagcgggacgcgattttaagaatcgaaagagaggaattttatcgatttagaataggtttcggagagttagcgtttaagttttgatttttatttaagattttttttttagggtcgttgttagtcgaagataggaattttgaggttttgtttttggatattatcgagttaattgtttgttttgtattattttgtttttgcgtaggtgacgagtaaaagggtatttgtgtcgtttgttttgtttagtcggagaagttacgggtgtaagatggcggtattcgttatagtttttcgtttttttgtagagagcgttcgagtcggcgtattattattttgtagttttattcggtcgtttgtattatgtcggttttcggtgtttattagttcggttcgtcgaggaagggcgcggattacggtcgtagtaacgcgtacggatagtatttttgtagttatttcgtaggcggtatttttgtagtcgtagttttcggattgattgggataaaatggtcgagtcgtaaagaaggttaagatagtcggtttatttgattcggaagtattgtttttcgcgtttattattttttttttcgttttcgtcgttattttgtattttttggtaggttatttatttttttatgtaatatttttaagtttaaattttaaaatgaatgattagatatatttcggttttggttttggtattcgttatatatttattttggttttttgagtcgattttgtggttgtttcgggtgattacgtgggtagttgaatttgttaagtagtagtttttaggttttatttggtgttagaggatgagggttttattcgtttggggtcgcggttgttttgaggattagggcgattaatagtgtcggtagtgttagatcgtggtttagtacgagtagtaatagtgaatagttaaatttcgggattggttattagtagggagttttttacggagttcgttaatttgtagattttagttttattttagattttttgagtcgaaaattcggggtaatttgaatttttaataaatattagtatcgttttacgtgattcgatttgcgtttaggttaaagatttttagtttttttagatttattttaaaagaattttgttagtgaattagagtaaattgtttaaaaattttgataatcgggggaggggagtattaagataaatagttaatatatgcggagtttaatatttaggtgatgggatgatagttatagtaaattattatggtatatatttatttgtgtaataaatttgtacgttttggatatgtatttcggaattttaaattaaaaaaaatatattaataattataaggaggtttagaagagttattgttaattttattgagaattgtttagaattagaagtttatattaggataggacgaggattcgtttttttttttgttaatatttagtttatgttattgggaattttgtttttttatttggagttaaagggagatgatgaaaaaatattttttatgtttatttggatgggttttttttttttttttatagaattattatattgagattttggtgatatatgtaagattggtgtgtgtgtgtgatgttggtattattatgttatagtggatatttattaacgttgtttttattttttttttttttttatttatttattttattttatttaagatagggttttattttgttgtttaggaaagagtgtagtgggtttattattatttattgtagtttggaatttttgggttggagtaattttttgattttagtttgtgtttttgtggttttattattatgtttggttaatttttttgtaaagacggcggtggtgggtagggcgtggggggaggtttttttatgttgtttaggttggtttcgaatttttggttttaagtgattttttttttttagtttttgcgttgggttcgttttttatcgtttggagaagtatttttagttttattttttaaattttggtttatatttagaatttgaattttggtgaggtaaataaatattcgggttataagggttattttttgaaatatggtttgtaaatacgtgattagttatttttttttttagtattttattttttttaaggtaagttatgggaaaatagagtagtagtttttttgggaattaggggtataaaaaggttgtttaagttaggcgtagtggtttacgtttgtaattttagtattttgggaggttgaggcgggtggattatttgaggttaggagttcgagattagtttggttaatatggtaaaattttatttttattaaaaatataaaaattagttcggtatgggggcgggtatttgtaattttagttattggggaggttgaggtaggagaattgttttaattcgggaggtagaagttgtagtgagttttagattgtattattgttttttagtttgggtaataaaagtgaaattttatttaaaaaaaaaaaaaaaaaaaaagaaagaaaaaaagaaaagaaaaagaaaaaggttgtttaagtaaaataaaatatagagataaatttataaatttaaaatatttgggaagtaataattgttatttagggtatatatataaatagggtggtttttggtacgttagaagaataaatagatggttagaggttttatttttgtaaaagagaaatatagttaggaatagtggtttatgtttgtaattttaatacgttgggaagttaagatgagaggtttatttgagtttaggagtttgggagtgtagtgagttgtgattatatcggaatattttagtttgggtaataaagtaagattttatattaaaataaataataaaaaaagagaattgttgtatattgttttttaagaaagtttattgttattagtaaggttttggggagttggtaagttttgattggtaagtaatggtaattaggtaaaacgatttttagagttattgtaggttgtttttagtagttaattagataaaattggtttaggttagtcgggtacggtggtttacgtttgtaattttagcgttttgggaggtcgaggcgggtggattatttgaggttaggagtttaagattagtttgattaatatgatgaaatttcgtttttgttaaaaatataaaaattggttgggtatgttggcgggtgtttgtaattttagttatttgggaggttgaggtaggagaattatatgaatttggaggtagaggttgtagtgagttaaaattatgttattgtattttagtttgggcgatagagtgagattttattttaaaataaataaataaaaaaattggtttaggttatagcgggtagttttagtagttaggtttatagataattatatttttggagtaatgttatgtgttttgagtgtttttttttttttttattttttgatattgttttagttggggatgataagaatgatttaattaatttttataagttaataggaaaaaatatcgtttttaaaaataataaggtcgggtatggtggtttacgtatgtaattttagtatattgggaggttaaggtaggtagatcgtttgaggttaggagtttaagattagtttggttaatatggtaaaatttcgtttttattaaaaaattaaaaattagttgggggtggtggtgtatatttgtaattttagttatttaggaggttgaggaaggagaatcgtttgaatttaggaggtgaaggttgtagtgagttaggtggaggttgtagtgagttaagattgcgtttttgtattttagtatgcgcgataggagtgagattattttaaaataataataataataataataaaattagtcggtatggtggtttatatttgtaattttagtattttgggaggttgaagtaggttgattatttgaagttaggagtttaagatgagtttggttaatatatcgagatttttgtattttttgttttatttttagttgggtatggtggtatatgtttgtaattttagttatttaggaggttgaggtacgagaattatttaaatttgggagatggaggttgtagtgattattgtattttagtttgggtaatatagtgagattttgtttgaaaaaaaaaaaaaggtcgggtatggtggtttatgtttgtaattttagtacgttgggaggttgaggtgggcggattacgaggttaggagatcgagattattttggttaatatggtgaaatattgtttttattaaaagtataaaaaattagtcgggtgtggtggcgggtttcgtgtagttttagttattcgggaggttgaggtaggagaatggcgtgaattcgggaggcggagtttgtagtaagtcgagattgtttaattgtattttagtttaggtaatagtataagattttttttaaaaaaaaaaaaaaattgtagggatattttgtaaaatttgtagtgataaaagtggataaaagatataaagataattttttttgttttatattgaagggttgtattagtttatttgaaatttggttatagagtagagatatatttagtttttgtttttttttgttttttgtggtggatttttaatttgtcgtttaggttggagagtagtgttttaattttagtttattgtaaattttgtttttagggtttaagtgatttttttgttttagttttttaagtggttgggattataggtacgtgttattatgtttggttaatttttgtatttttagtagagatggggttttgttatgttggttaggttggttttgaatttcggattttaggtgatttatttgtttcggttttttaaagtgttgagaatataggtgtgaggtatcgtatttagttagagtagagatatgtttgaagtaaaaagaataagtaagataggttgggtgtggtgttttatgtttgtaattttagtattttgagaggtttaagtgggagtattatttggggttaggagtttaaaaatagtttgggtaatatagtgagattttttttttataaaaaatataaaaagttagttgggtgtggtggtgtacgtttatagttttagttattaaggaggttgaagcgggaggattgtttgagtttaggagtttaaggttgtagtgaattgtgattattattatattttagtttggacgaaagagtaagattttgtttttaaaaataaaataaaataaataataaataagtttggtttgttagtaagttttttttgaaaagaaaattattttaggttgggtgtgttggtttatatttgtaattttagttttttgagaggtcgaggtaggtagattatttgaggttaggagtttgagattagtttgattaacgtggtgaaatttttcgttttattaaaaataaaaaaattatttttgtatgttagtataagtttgtaattttagttattagagaggatgagataggagaattgtttgagtttggggacgggggttggaggtcgtagtgagttaagattatgttattttgtattttagtttaagcga

SEQ ID NO: 7 - DNA, 5525 bp, Artificial Sequence
  Chemically treated genomic DNA (Homo sapiens)
atttttttttatggtaattgggattagattgttttatttttcgatatttttgtaagatttttttatgaatattttgatatttttttgagtttggagaaaggcgttttttttgtgtatttagtttgataaattttttagttatagtttttattttggtatgtaaagttttgtatttattatattttgtattgacgttatttttataatttcggcgttgtttataggagatgatagtaatatattttattaaataatttgggagtttaattgttgaaggttttatggaggtagtgtaattttttttagtttttttattggaatttggattggagttatttagtttggtaattttttttttttttttaagatttttttttttttttttaatagttttaatgtcgtgtttttttatttggtttttttttttatgttttttagatttttttttggattttttgtgagatattgaatggtttttttttataggttttggatattttaatagaattgaattagggggtaaggtttttagagaagttttagaggtatatttgttttgttggtttttatagatattattgttttgattaaaattgttaataggtaggttttgagttttcggttttttggagtgttaggggaattggagttagaatttataatttgaggaggatgtgaaatcggtagatgggttgaaggtaagcggtggaggggtggggatggtagtagttgtagggggtagagggaggtttgtagtagattttttattggtgggatttaaatgattatttagtgttggtggtattttgttcgttaggtgagatattcgggtttttttatttattaaatgattaataaattttgaatttaaaagtcgtgtttgaggagaagatatagcgtttttattagaatatattggagattttgaacggttggtgtttgtagtattttgagatggatttagttttttagagagtattgattttaatgattaagtgtttattttattgtatttaggttagtttttttgaagttttttaaaaatataattttttgaagtatacgagaggtttttaggatttagattggttatttgttgtagaattgtttttagggagtttttgtttttttgattgatattatttttttggagtttagtaagtagtttcggttttttgtaggtttttagggttagtaagtgaattattttgtttttgtatggtttttgagagacgttgttgttgttgtgtgtttatcgaattggatttgtagggtttatgggggttgattttttttttttaggaattgtatttgaaatagtttgaggtgtttttcgaatttgtatttttttttttatatatggtttatcgggtttgataatttttgtgtttcggttgcgggattttttttttgtttgggtcgttttttttcgtgttatttgattcgagtcgtttgttgtatatattgtaattttattttgtataaattttaggtaattgagttgggaggttttagagttggagaatgtttgttggacgtagttaaagttgttttgagggttgtttttgtttatatttgataaataaaagttaaagttatgaattttattgaggggattatttttgggaattttgataagtttttggagtttttggaattgaattgaaggtcgaaaagaaattaaatttttgtggttttggtaagtttggagcgtttggatcgtcgattcggtgagttttatatgtagtacggtgatgttgttttgttttagtcgttcgtattagagtttatagcgttgtttcgcgatttttttattttcgatattttaaatttttagaggtgtcgtcgtcgttagtttagttttagtttttattgcggtcgtagttatttgggtttttgtagtcgtcgttattgttagggttatttcgttgttggcgtattgttatatattgcgcggagttagatttcggattgttatcgtcgttatttgttttattttttggtttcgcgtttcgttttaggttagttttattggtttagtttttttagaatcgtttttatcggtcgttttttatttttacgggggcggggtttaaagtcgttggagttttgtttttgggattggacgttcgagaggtaagagagttattataaggttttttaatttttatgttttttttagtggatttttaggttattgtggtttgtattattaggttatttataaaaatgaatatttttttaaattaggttattttatagtaaattacggtttttgattattattatgttttgaataaagattatgagtaattgtatttgaatgttgttgaattttattgattgaattttgaattgtttgattttgattaggttggtttgtggaaagtgttattaagaagagttttttagttcgttggtattatttttttgatagttattataaaagtttttttgatgtatttttttaagaattttaaatttttatatgtagttattttttgtatattaaatggtttttttatggttaggataataaaaatatgaagaaagtatataagattttaattaatttgacgttgtgaattgtgaattttgaattgaaattaagtaagttttttatgattaggttttaaggttttggttagttttttaaaattgagaggttgaaattttttgattaaaattaatatatttgttttttttttttagtttttggaaattattattttaattttgtttttataaaatagtaaattattttagagtttatatataagtgagattatgtagtatttatcgtgggtttattttaaggttttgagtaaattattatttttttgtgttagggtattttgagttagttttgttataaattattttgtttaggtaatatattgtaaaacgttttataatttaatggttttttttttagaaaaaaagtagtgaaagttttaatagttaaaaagtgtttaatttaattgatttttgggaaaaaatattcgtataattttagatagttttaatttttgaaggtaatatagtttggtttttgttgataaataaataaaaataaaaaaattatatatatatatatataaattagttttttgtttttaagtgtgtaagaatgttagtatttaaaatttttaagatatataaaaattaaatagaattgtttaagtttttaaagggagtttggaaatttgaagaaagtaaagttaaaaatattgttttatgagttatataattatttttttttttattttttatagttttttttttatttattatttaggtaattttgtatttaaatttaataatttaatattttatttgttataagaatacgttattatgttattttaagtttttttgggtaaattatatataattagataggttgggttagggttgtttataagattttagtttagagtgtggtgtagtagtttattttttttaggatttttgttgtaataggatatgggagaagggaaatattaacgttagtagaatgggaggaattagattatggagatatgatttttgttttttggtatttttttagttgatttagaagaggatatagagggagatagatatatggttatttttataattataaattttgttatatgttgagaggatggttttttaaagttagttagtgtataagtagtggaggttgggattgttttattttttttgtttagggttatatagtttggtagatttggaaagatttttttgagaaagtgattttggaattgatattttagtggaaataattaggtattgggagggggtgaggtgaggagaaggttaagaatttttatgtagagggaattttgtgtagagattttagttaggaagaggttttgtatagtggaggaattgaaagttaatagttaggttatagtatagagtaaatgatgttggggtgtgaggtgatgttaaaaggtagatattagggttagagggcgtataattttgtaggtcgtgttaatgattttgttttttatttaagaatgttattttaggagattagttaaaaggttagggtgatggtgacggtggaaatatagaaaaaggaatttatttaagaggtatttaaaaagaagtgaaatagagatgagttggagatagattggataaaaagagtgagggagagggaggtgttaggttgtagtttaggttttgagttgttaaagaggagtttttttttttaggtgagttaaggtttagaattacgatttttggttatttttttttatttttagtgtgagaagtggcgagttggttgtttaggtatatattgttattttatatttattgtttaagatagaggcgtatatttggaaagtgaatgagttaggagttagaggagaaggtatgtcggtagaggttagggcggagaggaggaagagagtttgggggcgcgtttttaaaaaggagttagggaagatagagtagaggtcggggaggggagagtaaggattatgataggaggaaagagaggttagggaatattgaggtggaggaattttgggatatgatagttgtaaagaattgtagttaatttaatttagtttttttaatgtgtaattgaggaaattaatttttatgcgtttattttattgtaaatgtggtatttgtatttgagaaattttggaaaatataaagatgtaaagtaaattaagattatttatagtttttttatttagagatatgtattgttaaagtaaggattttgatttttttttttttttgtatttttattatggttggaattgtaatatagacgtaattttatgttttgtttttaaaatataaataatggttgtaaagcgttttatacgttgatttaaagttttttttgaaataggaaattgagatacgtcggttgtgaaatttattgaagtgagcggcggcgttaggatttttgggatttcgatttttttgtagttcgtatagttaagggcgagggcgtttttcggtagaagtagtaaatcgtcggtaagtttagcgaggagggttgtcggggtttgggtttgggaattggttggtatttagcggaaagggacgtgagttgagcggcgggggagaagagtgcgtaggttagaaggcggcgcgtagcggcgtttcgcgaggtttttacgtcgggcgatatggggtgtttgttgtttttgttgttttgggcgtttttttaggtttggggaagcgttgaaggtgggtggaacgagggcgtttgagtgtattcgcgggagggcggagagagggagttgggtagggacggggagggtaacgtttgatggggattggtgagattcgggacgtattggcgcgatttaggtagaaaattcgttgttttttggtttcggggagaggtagcgcggtatagagttcgttggtattagtcgttttttgaagtttatttttttttgttttttttttttttttttttatgttggttgttttttcggttatttgttacgcgtttttaatttttatttttttttagt

SEQ ID NO: 8 - DNA, 5525 bp, Artificial Sequence
  Chemically treated genomic DNA (Homo sapiens)
attgggagagaatgaagattggaggcgcgtagtaagtggtcgggagagtagttagtataaagagaaggaagaaagaaataagaggagatgagttttaggaggcggttgatgttagcgaattttgtgtcgcgttgttttttttcggagttagggagtagcgagttttttatttagatcgcgttagtgcgtttcgggttttattagtttttattaggcgttgtttttttcgtttttatttagtttttttttttcgttttttcgcgagtgtatttaagcgttttcgttttatttatttttagcgtttttttaagtttggaggagcgtttagagtagtagaaatagtaggtattttatatcgttcggcgtggggatttcgcggagcgtcgttgcgcgtcgttttttgatttgcgtatttttttttttcgtcgtttagtttacgttttttttcgttgggtgttagttaatttttaagtttagatttcggtagtttttttcgttgggtttgtcggcggtttgttgtttttgtcgaagggcgttttcgtttttagttgtgcgagttgtaaagaggtcggggttttaggaattttggcgtcgtcgtttattttagtaggttttataatcggcgtgttttaattttttgttttaaaggagattttgggttaacgtgtgggacgttttataattattatttatgttttggaagtaggatataaggttgcgtttgtgttataattttaattatggtaaaaatgtaaagggaaaaaaggattaaagtttttgttttagtagtatatgtttttaggtggaaagattatgagtgattttaatttgttttatatttttatgttttttaaaattttttaagtgtaagtattatatttataataaagtaaacgtatgaaaattaatttttttagttgtatattgagagaattggattaggttggttataattttttataattgttatattttaggatttttttattttagtgttttttagtttttttttttttttgttatggtttttgttttttttttttcggtttttgttttgttttttttgatttttttttggggacgcgtttttagattttttttttttttttcgttttagtttttgtcggtatatttttttttttggtttttgatttatttattttttaaatatgcgtttttgttttaaataataagtgtaagatgatagtgtgtatttggatagttaattcgttattttttatattgaaaataagaaaaagtgattaaaaatcgtggttttaagttttagtttatttggaggaaaagatttttttttggtaatttagaatttgggttgtagtttgatattttttttttttttattttttttatttaatttatttttaatttatttttattttatttttttttgaatattttttgaataaatttttttttttatatttttatcgttattattattttaattttttgattgattttttgaagtagtatttttgggtagaaaataaaattattagtacggtttgtaagattatgcgttttttagttttggtgtttattttttgatattattttatattttagtattatttgttttgtattgtagtttggttgttagtttttagtttttttattatgtaaaatttttttttgattaaggtttttgtataaagttttttttatatgaaagtttttgattttttttttattttatttttttttaatgtttagttatttttattaaggtattagttttaaggttatttttttagggaagtttttttagatttgttagattgtgtgattttaggtaggagaagtagggtagttttaatttttattgtttgtatattaattggttttgagaagttatttttttagtatgtagtagagtttataattatagaaatggttatatgtttgtttttttttgtgtttttttttaaattagttggagaggtgttagaaggtaaggattatgtttttataatttgattttttttattttgttaacgttaatgtttttttttttttatattttgttgtagtaagagttttagagaaaataggttattgtattatattttaggttgggattttgtagatagttttaatttagtttatttaattatgtgtaatttgtttaaaaaagtttaaaataatatagtaacgtgtttttgtaataaataaggtgttaaattattaaatttggatataaaattgtttaaataatggataggagggaaattatgagaaataaaaagaaaaataattatatgatttatggggtaatatttttaattttattttttttaaatttttaagttttttttaaaaatttgaatagttttgtttagtttttgtgtattttaaaaattttaagtgttaatatttttgtatatttaaagataagaagttggtttgtgtgtgtgtgtgtgtggtttttttgtttttgtttgtttattaatagaggttaggttatattatttttagaagttaggattatttggaattatacggatatttttttttaaaggttagttgagttagatattttttggttattggaatttttattgttttttttttgggaaaggaattattgaattatgaaacgttttgtaatatgttatttaaataaaatagtttataataagattgatttagaatattttagtatagagagatggtgatttatttagagttttaaaataagtttacggtgggtattatatgattttatttatatgtggattttaaaatagtttattattttatggaaatagagttagggtagtggtttttaggagttggagggaaggggtaaatgtgttaattttggttaaagggttttagttttttaattttgagaggttgattaaaattttggagtttgattataagggatttatttggttttagtttagaatttataatttataacgttaaattagttggaattttatatgttttttttatgtttttgttattttaattataaggagattatttaatgtataaaggatagttgtatatgagaatttaagatttttgagaggatatattagggaaatttttataatagttattaggaggataatattaacgaattaaagaattttttttaatagtattttttataagttaatttgattaaaattaaataatttaaagtttagttaataaagtttaatagtatttaagtgtaattgtttatagtttttatttagagtataatggtgattaaggatcgtagtttgttgtaaaatggtttgatttaaagaggtatttatttttgtaagtagtttgataatataaattatagtaatttggagatttattaaaagaaatataaggattagaaaattttgtgatagtttttttatttttcggacgtttagttttaggagtaaaattttagcgattttgggtttcgttttcgtgaaagtggaaggcggtcgatgaggacggttttgagggaattagattaatgagattagtttggggcggggcgcggggttagagggtggggtaggtggcggcgatggtagttcgaggtttggtttcgcgtagtatatgatagtacgttagtagcgggatggttttagtagtggcggcggttgtagaagtttaagtagttgcggtcgtagtggaggttggagttggattggcggcggcggtatttttgggagtttaagatgtcgggggtgggggggtcgcggggtagcgttatgggttttagtgcggacggttggggtaggataatattatcgtattgtatgtgaagtttatcgagtcggcgatttaggcgttttagatttattagagttataagaatttaattttttttcgatttttaatttagttttaaagattttaggagtttgttaaaatttttaaaaatgatttttttaatgaagtttataattttaatttttatttgttaaatgtgggtaaagataatttttagggtagttttgattgcgtttagtaaatattttttagttttggagttttttagtttaattgtttgggatttatataagataaaattatagtgtgtgtaataaacgattcggattagatgatacgagaaagaacgatttaggtagaggaggaatttcgtaatcgaagtatagaagttattaaattcggtggattatatgtagggaaaagagtgtaaattcggaaagtattttaagttgttttagatatagtttttgagaggaaaaggttaatttttatgaattttgtaaatttaattcgatagatatatagtagtagtagcgttttttagaagttatatagggatagggtggtttatttattggttttgaaggtttataagaaatcggagttatttgttagattttagaaagatggtgttaattaaaaagataggaattttttgggagtaattttgtaataggtagttaatttgaattttaaggatttttcgtatattttaaaggattatgtttttaaagagttttagagagattggtttggatatagtgaaatagatatttggttattggagttaatgttttttagaaaattaaatttattttagaatgttgtaggtattagtcgtttagaatttttagtatgttttagtagaaacgttgtattttttttttagatacggtttttggatttagagtttattgattatttaatggataaaaaagttcgaatattttatttgacgagtagagtattattaatattaaatggttatttgaattttattagtgaaaaatttgttgtaggtttttttttgttttttgtagttgttgttatttttatttttttatcgtttgtttttaatttatttgtcggttttatattttttttagattgtaaattttaattttaatttttttagtattttagaaggtcgggggtttaagatttatttgttgatagttttagttaaaataatagtatttatgagaattaataagataagtatatttttaggatttttttggaaattttattttttggtttagttttattaaagtgtttaaagtttatggaagaaaattatttagtgttttataaaaagtttaaaaagaagtttaaaaaatataaggaaaaggattaaataaaaaagtacgatattgagattattgaggaaaaggagaaagattttaagagagaagaggaaattgttaagttaaataattttagtttaaattttagtggaggagttaaagaggattgtattgtttttatggaatttttagtaattgaatttttagattatttgataaaatatattgttattattttttatgagtaacgtcggaattataaagatgacgttagtgtagagtatgatgagtatagagttttgtatgttaggatggagattgtagttagaagatttattaaattagatgtataaagaaagcgtttttttttaggtttaaaagagtattagaatgtttatgaagaagttttataagaatatcggaagataaagtagtttagttttaattattatgaagaaaaat

SEQ ID NO: 9 - DNA, 6621 bp, Artificial Sequence
  Chemically treated genomic DNA (Homo sapiens)
tttgtatttttagtagagatggggttttttttttttttttttttttttttttgagagggagtttcgtattgttatttaggttggagtgtagtagtgttatttttatttattttaattatcgttttttaggtttaagtaatttttttgttttagttttttaagtagttgggattataggtgtttattattacgtattattaattttttgtatttttagtagagatggggttttattatgttagttaggttggttttgaatttttgattttatgatttatttatttcggttttttaaagtgttgggattataggcgtgagttattatgttcggttaagatggtgttttatcgtgttggttaggttggttttgaatttttgatttcggttttttaaagtgtcgggattataggtgtgagttattgtgttcggttaggagttttattgtgaagggaaggaatgaatatagttggaggggaaagtggtattaaggaaaggttttttattattaataataaatattttattgaaatatattatttatatagaatagttaataaattttgagtgtgtagtttaatgaatttttataaggtgaatatatttaggtaattagtatttagattaagaaatggaaagtggttaggtgtagtggtttatgtatataatgttaatattttgggagtttaagacgggaggatcgtttgagttcgagagtttgagattagtttgggtattatagttagattttcgtttttaaaattatatatatatttttttttgagatagagttttgttttgttgtttaggttggagtgtaatggtatgattttagtttattgtaattttcgttttttgggtttaagtgattttattgttttagttttttaagtagttgggattataggcgtgtgttattatattcggttaattttttgtatttttagtagagacggagttttgttatgttggttatattggtttcgaatttttgattttatgatttatttatttcggttttttaaggtgttgggattataggcgtgagttattatgtttagttaaaataaaaaataaaatttttaattagttaggtttatgggtgtatgtttgtagtttaggttatttaggaagttgaggtgggaggattatttgaatttagaagttcgaggttatagtgagttatgattatgttattgtattttaatttgggttatagagtaagattttgttttaaaaagtgaaaaataaataagaaatagaatatgattagttgttaatattttttttatggttttttgtagttattattatttttttgaaaggtaattagtattataattaattttttttttttttgagacggagtttcgttttgttatttaggttggagtgtagtggtttaatttcggtttattgtaatttttattttttgggtttaagtaatttttatgttttagtttttatagtagttgggattatagttgtgtattattatatatggttaatttttgtgtatgtatatatgtgtgtatatatatgtttgtgtatattatatgtgtgtatatatgtatattatatatgtgtgtatatatgtatatatatatatatatgtatatgtatatatatatatatatgtatatgtatatatatatatatatgtatatgtatgtatatatatatatgtatattatgtatatatatatatgtatgtatattatgtatatatatatatatatatgtgtgtgtgtgtatatatatatatatttttttttagtagagatgaggttttattatgttggttaggttggtttcgaatttttggttttaagtgattcgtttgttttagttttttaaagtgttgggattataggtgtgagttagatttaaatagtatgttttttttgtgtttttttttttatgtttgatagttgatgtgagatttatttttattgtgggtagcgtttttgttttttttattattgtataaaataattttgttttatttatttattttattgttgatgggtattagggttgttttttgtttggagttaaaatgattaatatggttatgaatatttgtgtatatgtattttggtatatttgaattgtattgtagtttttgtgttaatttttttttttttatggttttttgtggttattttttcgtttttttatatgatttttatagttgtttgtgattttattttggttatttttagtgatttttttgggtgtatttttgaattatggattcggttatttttttgtggtttttattttagttttagttttgcggttttgttttattatattaagtttttaatgttggtgttttttagatttagggttttaaaaattttttgtatatttttaatgggtattattatttttatgttaattaatattaaatttgttttttgattatattttttagttagtttattagtataaaattgagtttattaaatttttttaagaagtatgtttttaattgttgaaatgttatatttatttaggtatttgaattattatttaagaattattttagtttttttttttttttttagttttttataattttaatttttaattattaaaatttgatgagatttattttttttagggtttatagaattattttttttttttgtttttaaggtttttattttgttttagaattttttagatttttgagatagttattttttttttttttaggtttttttatttttttttattgatttattttaaagtaaatttgattcggttattatatattttttattgtttataggataaggttaaattttttagtaaattttaatttttttaagaattgttttttatagttagttttatgtgtttattttagaatcgattggattaatttaggagtagttttcggtaagtacggcgtttttttttattttttggttgtcgagggtcgtttttttagaaagtattttttattagttttaagttttttttttttagtaattttgatttttagttttaattttttttaggacgtgttttttatcgtattgttttttttagttttcgttttttttttaggtgtttattatttttttataaattatagttattgttatggtaataattttattattagaaggagttttatgtttagcggattagagttttttgagagtagggattgtggtattattttaagtattgaatttgttttagtaatttttaaataaatatatgttgaatgaatgaatgtagtaataggaatgttgagttaagttttgtttttgttttttgagacggagtttcgttttgttgtttaggttggagtgtagtggttcggttttggtttattgtaagtttcgtttttcgagtttagttatttttttgttttagtttttcgagtagttgggattataggcgttcgttattacgttcggtaattttttgtatttttagtagagtcgggttttattatgttagttaggatggtttcgattttttgatttcgtgattcgttcgtttcggttttttaaagtgttgggattataggcgtgagttatcgttttcggtttgttgagttaagtattaaattatataaaatataggaggagaggaaagtatttagagatacgatagggagaattatttgaaatagtgggattatagattatgtgaattgtgtagagaggtttaaatagtttggggtttttggagggaagggaggtttttgggtggtggagtattggtgtatagaaaaggagatgaattttgagagagaggttttttattgtgaagggtttggtgttggggttaaaggtttggggtttttatttgtttagtatggttttttaaattgtagggttttttttttttgagtggggggtagggggtgttttattttgttgtttaggttggttttaaattcgtgggtttaggtaatttttttatttcgtttttttaaagtgttgggatgataggcgtgagttattaagtttagtagtaggttgtaattaaattatgtatttatggtttttaaaattcgtttaggagttgttataggttcggcgttgtaaaagtaaatatgtttatttagaaaatggggataatttttatgttatagagttgtaaagattaaatgaattaatatagattaatatattgggaatagtgttaagtgtataagtattatgtaaattttagttattatttgttattattgtgtttgttgttatttttttttaggagtttttagggggttaagaagtggtgggaaagaaagaaatgattttaagagtatttaataagggttagaatggaagtgagtaaaaaatgttgaggtttatagtataggttgtattgcggggtttaaattttatgaggttagtagtatttagggtttgtgagttttttagagttgggttttggtggtcgagtttagttttgggggttattgtatttttttttttattataaaatggggtttggaggttcggggcggaagaaaggggtttataatattgtacggttagaggtcgagttaaggttggattcggttagatttttataggttttttttagtttttatattgttttagagtgtggggcgttcggttgggggcgaggtagcggaggtttaaagggggtcgaagttaattggacggtagttcgcgatgggaattacgttttttagtatgcgacggggtaaaggggttttttagtcgcgagtagcgtttcgtaggttttgttgggagtttttattgatttttgtttttttttttattttgattttcgtttttttgttttgggtttcgtttttttttgagagtcgatgatttggtagagtttcgcgagtcgttttttttttttttttttattggtttagtttagttgttattcggttgagaggaggagaagttgtttattgattggtggatttcgtttggcgttaattaggaaaggggggcggggtagtagttggttttattgagtcgttattatcgcgaaaggtcggtttggttgcgatagtttgggtaagaggtgtaggtcggtttggttttttgttattcggagttgggtaagcgggtgggagaatagcgaagatagcgtgagtttgggtcgttgtttcgaggttttcgttcggttttttttgtcgattcgttacgtttgtttggatttaatttttaggttgtcggcgttcgttcgttcgttggtttcgcggtgtgagagggaagtattcgtgtttgtggttggtggttggcgtttggagggttcgtatattcgttcggtcgcgtcgtttgttcgcggtagtcgcgtttttgaatcgcggagtcgtgtttgtgtttgattcgcgggcgtcggtggcgcgcggtcgaggtcggtgtcggcggggcggggcggtcgcggcggaggtagaggaagagggagcgggagttttgcgaggtcgggcgtcgttatggaattgggttcggagttttcgtatcgtcgtcgtatgtttttcgtttgtagtttttttttcgcgtcgtagttcgtcgtgaaggcgttatttggcgttttagtcgtcgggggattgtcgtttgttattaatttgatcgttattatggattagttgtagggtttgggtaggtaaggagagatcggcgggcggtgtttcgggtttttggtttcggtgtcggtttcggagagattaggttaggaaacggatcgggagaagggcgagattcgttcgttcgggttcgtcgttcggggatagtcgggttagggtttgttatgtgtattttcgttcgggcggaatgttgggcgggagaggtcgtcgggattttttaggggaagaggtggagatttttgggtttaagttcgagttaggtttatttttatttttttcggattgtttcgtattttttttttatttttatttttggaagttttttggaatttattttcgcggggaaaattaggtttttttaggtatttatttttattttttgttaaattatttttaggattttcgtttgttgtgatttttgtttttttttaataaaggattatggtatttttttttttggcgtttatgtaaaattattttagtttttcgttttgtgtatatttttgatgtttattttgttgtttttttaaggttaggtttttttatttaatttttagaaagttttttgggttttttttgatagtaaaaaatgtattttacggtgtttttcgcggaagagttattttttttttaatttttggtatttcgtttgttaagtatatgttttgtgcgttttttaatttttgaaaagtagaaagtgttttgtttaatttttatttcgattttgttttagtatttagaatatatgtttttattttaggaaatattttaatatttgttatagttattataatttgtaatgtggtttaaggttatgtttatttatttttttttttttttttgtttaagtgttaattgggtgtttagagtggtaaagtgggatttttgttatttgtggtgtggtttagaaatggtttttggtagtttggttgttttttaattttatggtttattttttgtatgtgattttttaattatattttataaattatttatggtttatttttgttggttttagt

SEQ ID NO: 10 - DNA, 6621 bp, Artificial Sequence
  Chemically treated genomic DNA (Homo sapiens)
attgaaattaatagaaataaattatgaatgatttataggatataattaaaaggttatatgtaggagataggttatgagattaagaagtagttaggttgttagaaattatttttaggttatattataagtggtaaagattttattttgttattttgaatatttaattagtatttgggtaaaggagaaaaaaggagtgggtgggtatggttttggattatattgtaggttatgatggttatggtaaatgttggggtattttttaaaataaaagtatgtgttttaagtattgagatagagtcgggatgaaagttgaataggatattttttgttttttagaagttgggaaacgtataagatatgtgtttagtaaacgggatgttagagattgaagggaaagtagttttttcgcgggaaatatcgtgggatgtattttttgttattaggaaaagtttaggaagttttttgaaagttgggtaaaaagatttggttttaggaaagtagtagagtggatattaggaatgtgtatagggcgagggattgagatgattttatataaacgttaggaaagaaaatgttatggttttttgttgagaaggaataaagattatagtaaacgaagattttgaggatggtttagtaaagggtgaaagtgagtgtttagaagagtttgatttttttcgcgggggtagattttaaagagtttttagggatagagatagaaggagagtacggagtaattcgaaaggggtgaaggtgggtttggttcgggtttaggtttaaggatttttatttttttttttggaaggtttcgacggtttttttcgtttaatatttcgttcgggcgggggtgtatatggtaggttttagttcggttgttttcgagcggcgaattcggacggacgggtttcgtttttttttcggttcgttttttggtttgattttttcgaggtcgatatcgaggttaggggttcggagtatcgttcgtcggtttttttttatttgtttagattttgtagttggtttatagtgacggttaggttggtgataggcgatagtttttcggcggttgaagcgttaaatagcgtttttacgacgggttgcgacgcgggaggggggttgtaggcgaagagtatgcggcggcggtgcgggggtttcgggtttagttttatggcggcgttcggtttcgtagagttttcgttttttttttttttgttttcgtcgcgatcgtttcgtttcgtcgatatcggtttcggtcgcgcgttatcggcgttcgcgggttaaatataaatacgatttcgcggtttagggacgcggttgtcgcgggtaagcggcgcggtcgggcgggtgtgcggattttttaggcgttagttattagttataggtacgggtgttttttttttatatcgcgaggttagcgggcgggcgggcgtcggtaatttgaagattaaatttaaataaacgtggcgggtcggtaagagaagtcgggcgagagtttcgaggtaacggtttaggtttacgttgttttcgttgtttttttattcgtttgtttagtttcgggtagtagaaaattaagtcgatttatattttttatttaggttgtcgtagttaggtcggtttttcgcggtaatagcggtttagtggggttagttgttgtttcgttttttttttttagttggcgttaaacggaatttattaattagtaagtaattttttttttttttaatcgaatggtagttaggttgggttaatgagaggggaagaagaaagcggttcgcgggattttgttaggttatcggtttttagaagggggcggagtttagagtagaagagcggggattaaaatgagagggggagtagaggttaatgaaaatttttagtagaatttgcgaggcgttgttcgcggttgaaaggtttttttgtttcgtcgtatgttgggaagcgtagtttttatcgcgagttgtcgtttagttagtttcggttttttttgggttttcgttatttcgtttttagtcgggcgttttatattttgaggtaatgtggaggttaaggaagatttgtggaggtttggtcggatttagttttggttcggtttttaatcgtgtagtattgtggatttttttttttcgtttcgggtttttaggttttattttataatgagggagggaatgtaatgatttttaggattggattcgattattagggtttaattttggagggtttatagattttgggtgttgttggttttatgggatttgaatttcgtagtataatttgtgttgtgggttttagtattttttgtttatttttattttagtttttattggatgtttttagaattattttttttttttttattattttttagttttttgggagtttttagagagaaataatagtaaatataataatagtaaataatagttaaagtttatataatgtttatgtatttgatattgtttttagtgtgttaatttgtattaatttatttaatttttataattttgtgatataggaattatttttattttttaagtgggtatatttatttttatagcgtcgaatttgtggtagtttttagacggattttgagggttataagtgtatgatttaattgtaatttattgttgggtttagtggtttacgtttattattttagtattttgggagggcgaggtgggaggattgtttgagtttacgaatttgagattagtttgggtaataaagtgagatattttttgttttttatttaaaaaaaaaaaattttatagtttgaaaagttatgttggataggtggaaattttaaatttttggttttaatattagattttttatagtgaggaattttttttttaggatttatttttttttttgtgtattagtgttttattatttaggaattttttttttttttagaaattttaggttatttaggtttttttgtatagtttatatggtttgtggttttattgttttaaatagttttttttgtcgtatttttgaatatttttttttttttttgtgttttatgtggtttaatatttggtttaataggtcgggagcggtggtttacgtttgtaattttagtattttgggagatcgaggcgggcggattacggggttaggagatcgagattattttggttaatatggtgaaattcggttttattaaaaatataaaaaattatcgggcgtggtggcgggcgtttgtagttttagttattcgggaggttgaggtagaagaatggttgaattcgggaggcggagtttgtagtgagttaagatcgagttattgtattttagtttgggtaatagagcgagatttcgttttaaaaaataaaaataaaatttggtttaatatttttgttattgtatttatttatttaatatatgtttatttaaggattattagaataaatttagtgtttgaaataatattataatttttgtttttagggagttttggttcgttgagtataaagttttttttaataatggaattattattatgataatagttgtggtttgtggagggatggtgggtatttagaggaggggcggggattggggaaggtagtacggtggggggtacgttttaaaggagattaaaattaaaggttaaggttgttggagaaggggagtttggggttggtgggaagtgttttttaaggaaacggttttcggtagttaggaggtgaggaggaacgtcgtatttgtcgggagttatttttgagttgatttagtcggttttagaatgggtatatgggattggttgtgagggatagtttttgaaaggattggagtttgttgaagagtttggttttattttgtggatagtggagggtgtgtgataatcggattagatttgttttagggtggattagtggaggagagtggggaggtttgaggaaaaaggaggtggttgttttaaaagtttgggagattttgaagtaaggtgggggttttggagataaaggaagggaatgattttgtgagttttgaaggaggtagattttattagattttgataattgagagttaagattgtagggggttagagggaagggaggaggttagaatgatttttaggtaatgatttaagtatttgggtggatgtaatattttaataattggaggtatattttttggaggaatttgatgagtttagttttgtgttggtggattggttggggggtgtagttaggaggtagatttggtgttgattagtatgaagatggtaatgtttattgaggatgtataaagggtttttaggattttggatttggggagtattagtattgaggatttgatgtagtgagataggatcgtaaagttggggttgagatagaaattataagggagtagtcgagtttatagtttagaggtgtatttaggagagttattgaaggtggttagaatgaggttataggtaattatggaaattatgtaggaaggcgaggaggtggttatagaaggttatgggaagggaaaagttggtatagaagttataatatagtttaagtgtgttaaaatgtatgtatataaatatttatggttatgttaattattttagttttaaatagaaagtaattttaatgtttattaataataaaatgggtaaatagaataaagttattttatatagtgatgaaaaggatagaagcgttatttatagtaggagtgaattttatattaattgttaaatataagaaggaagatataaaagagatatgttgtttaggtttggtttatatttgtaattttagtattttgggaggttgaggtaggcgaattatttgaggttaggagttcgagattagtttggttaatatagtgaaattttatttttattaaaaaaaaatatatatatatatatatatatatatatatatgtgtgtatatatatataatatatatatatgtgtatatatatataatatatatatatatgtgtatatatatatatatatatatgtatatatatatatatatatatatgtatatatatatatatatatatatgtatatatatatatatatatatatatgtaatatatatatatatatatatgtaatatatataaatatatatatatatatatatatatatatataaaaattagttatgtatggtggtgtataattgtaattttagttattatggaggttgaggtatgagaattgtttgaatttaggaggtggaggttgtagtgaatcgagattgagttattgtattttagtttgggtgatagggcgagatttcgttttaaaaaaaaaaaaagttagttatggtattagttattttttagaaagatggtggtgattgtaaggggttatgaaggggatattggtaattggttatattttgttttttatttattttttattttttgagatagagttttgttttgtggtttaggttggagtgtagtgatatgattatggtttattatagtttcgaatttttgggtttaagtgatttttttattttagttttttgagtagtttgaattataggtatgtatttataaatttagttaattaaaaattttattttttattttggttgggtatggtggtttacgtttgtaattttagtattttgggaaatcgaggtgggtggattatgaggttaggagttcgagattagtgtggttaatatggtaaaatttcgtttttattaaaaatataaaaaattagtcgggtgtggtggtatacgtttgtaattttagttatttgggagattgaggtagtagaattatttgaatttaggaggcggaggttatagtgaattgagattatgttattgtattttagtttgggtaatagagtaagattttgttttagaaaaaaatatatgtataattttagagacgggagtttaattatgatgtttaggttggttttaaattttcgagtttaagcgattttttcgttttggatttttaaagtgttagtattatatgtatgagttattgtatttggttattttttattttttgatttgggtgttggttatttgagtgtgtttattttgtggaaatttattgagttatatatttaagatttgttagttgttttgtatgaatggtgtattttaatgaaatgtttattattagtgataaaaagtttttttttgatgttatttttttttttaattatatttattttttttttttatagtaaaatttttggtcgggtatagtgatttatatttgtaatttcggtattttgggaggtcgaggttaggagtttaaaattagtttggttaatacggtgaaatattattttggtcgggtatggtggtttacgtttgtaattttagtattttgggaaatcgagatgggtggattatgaggttaggagtttaagattagtttggttaatatagtgaaattttatttttattaaaaatataaaaaattagtggtgcgtggtggtgggtatttgtaattttagttatttgggaggttgaggtaagagaattgtttgaatttgggaagcggtggttgaagtgagtggagatggtattattgtattttagtttgggtgatagtgcgagatttttttttaaaaaaaaaaaaaaaaaagaaaagaaagttttatttttattaaaaatataaa

SEQ ID NO: 11 - DNA, 5310 bp, Artificial Sequence
  Chemically treated genomic DNA (Homo sapiens)
aaaaaaaaaaaaaaaaaaattagaaaattaaaaaattaggtcgggtgtagtggtttatgtttgtaattttagtattttgggaggtcgaggtgggtagattatttgaggttaggagtttaagattagtttggttaataaggtaaaattttatttttattaaaaatataaaaattagttgggcgtggtggtattcgtttgtggttttagttatttaggaggttgaggcgggagaatcgtttgaatttaggaggcggaggttgtagtgattttagatcgtattattgtattttaatttgggcgatatagcgagattttattttaaaaaaaaaaaaaaaaattagttaggcgtgatggtatatatttttatttttaattatttgggagggtgaggtgggaggatcgtatttgagtttgataggttgaggttgtagtgagttgtgattatgttattgtattgtatttttgttggggtgatagtaagattttgttttaaaaaaaaaaaaaaaaaaagtttgattgttttagatttattttataatgattaatttgaattaagtcgttttattttttgtttggataattgtaatggagtttttattagtttttttgttttttttgttttttataatttttttaatattatttttttgtttaaaattaatagtggttgttttttttggttttttaagtaggggttaaagtttttataatggtttatatgttttataaggtgtgattttggtttttttatattttgatttattttttatttgttttttttattttagttatattggtttttttgttgttttaagtaatttattgtttcggggtttttgttttgttttttttgtttggaatgttttttttaaagcgtggtttttttattttttttaagtttttgttttaatgttattttatgagtaaggtttttgggtttttttgtttgtttttcgagtttttattattttttgtttttttgtgttttgttttgagtttggggagaatgatttttttagaaagtaatttgggtttttttgttttaggtttttgagtgggtttggtgaatgggaggtgttattaggagatgaaaggtaagaggggagagatgttggggtattttttttttttgtattttttttgttttgttttgggtagtggttgtgtttttttcgattatagttgtatttgggaatggattttatatttttttgtttttttatttacggatttttaataatatgattttttttttgatttttagtttttaaagtagttatgttttttagtttttgtttgtttttttggtgttttaatatttttgttgtttgggttttttgaattttgtttatttttttcgttttttttttaagatttgaatttttcggttgggcgtagtttttaacgtttgtaattttagtattttgggagatcgaggcgggtagattgtttgaggttaggagtttgagattagttcggttaatatggtgaaattttgttttaattaaaaatataaaaattagttggggatggtggtaggtatttgtagttttagttattcgggaggttgaggtaagagaatcgtttgaattcgtgaggcggaggttgtagtgagtcgagatttcgttattgtattttagtttgggtatggtagcgagatgttttaaaaaaaaaaaaaaaagtgtagttgttatggaaaatagtatggtgtttttttaaaaaataaagtaggttggagtgtagtggtgtgattatagtttattgtagttttaattttttgggtttaagttattttttcgttttagttttttgagtagttgggattataggttcgtgttagtaagtttggttaatttttttttttgtattttttgtagagataggggtttcgttgtgttgtttaggttggtgttaaatttttgggtttatttatttattttagttttttaaatgggattataggcgtgaattattgtttattgcgtcgggtttttttgtttttgtttttgtatacggtatatgttattatttaatatattatatttttacgtatttttttatttttttttattttttatattttggatggtaagttcgaaggcgtagggatgtttgtttattgttgtattttaagtggttggtatatcgtcggttgttagtaaatgtttttgaaatgaatgaatgagtgaatgatcgataaggggagttaaggggaaggtagcggtgcggttcgcgtcgtaggtagaagagttgattttttaattttcgttttttttttcgttttcgttcggaatgttgagtgttcgagaaggaggcggaaatgagcgcgtttaatagtttattagtcgggtgtttatttaattagggtttgtatttcgaggttcgtttgtgtttaatcgttcgtttaatggtttcgtttggtttcgggcgggcgcgggggaatttgcgaggcgagcgtaggtttggttattttgtttcgtcgggggtttattttattgcgtcgcgcgggtgcgcgtagatttgattttttttcgggtataaaaagcgttttgcgggagatttaggtcgggagggcgcggagtttagcgagtagttttaggtttttttaatcgcgtggtttatttttagttttagttttagttttagttgttgggtttattcgtcggttaagggaatgttttcgagatattagatgttagttgttcgttgtatttttagttatgaaattggaggattataacgttttttatttttttaatttaggggatgtggggatgttagaaagagagacggttcgttagatatttgagagtaataatattaggtagtatttgggtatttgttgtgtgttagatatgatgtttagcgttttaaattttttaatttatttaatatttatttatgagagggtaaaatattaagattataatagttttatttgatagatgtagaattgaggtttagggggtttattttattttttcgaggttttagcgttattaaggggtgggatttggatttgaatttaggtggggtcggttttaagggtttatgttaggtttgagagagtaagatttttattttcgtaacgtaagtaatttatggtttagttataggtttggcggggaggaggacggatagattattaggttagttttggaaggttaaagaatttgttatttaaaattttaggttgggtttcgttttttacgtttgtaattttagtattttaggaggttaagggaagcggattatttgaggtcgggagttcgagattagtttggttaatatagcgaaatttcgtttttattaaaaatataaaaattagtttggtgtggtagtgggcgtttgtagttttagttattcgggaggttgaggtaggagagtcgtttgaatttgggaggcggaggttgtagtgagtagagatgacgttatcgtattggacgatagtgagattttattttaaaaaaataaataaaataaaaaaatttttttagtttttagttcgttttttaaatttttaaatttgagttggggacggggagggagaaggattaggaggtggtatttagggttttttaaggtagtagtagaaggtgaaggaggagtgaggggataggtgagagagattgatcgggaaagtttagtttcgtggggaagggtttgtggggtagtgattgagatttaggatcgtttttatggttagagtttatttgtgtgtagtaagaggaaagtatttcgtgtttaacgtagtggaatgagagtaacgtagaagaataacgaattttaggtttggcgtttattttttaggaagggtgtgggagagttgttttttaagggagattttttggaggttgttttgcgtagtaagtagtttttatttagattatatatagtattttagattaattttaaaatttttgcgttttaaaaattgtttttatttatattttatagaaagttgagaaagtgttatttatatggggggtaggggtgttggagattatgagattaataataatttttttagttcgtattttttggtattattatagtttttaaattttgggattttttcgattagtttttttttgtttagttgtgaaatggaagaagcggttcgggtgtggcggtttatgtttgtaatttgagtattttgggaggcggaggatcgtttgagtttagaagtttaagattagtttgggtaatatagggtgattttttatttttttttcgttttattatatcgttataaaaaatttttaaaaattagtcgggtgtggtggcgtaagtttgtagttttagcgggagttgagggaggagaatcgttttagttcgggaggtcgaggttgtagtgagtcgagatcgcgttattgtatttttgggcgatagagcgagattttgtttttaaaaaaaaaaaaaaaagaaaaaagaggaagttgtatttaatttagaaacgcggtttttcgggatttgttagttttatatttcggaggatttttttcggcgggttggtacgggaggtggagaaagaggtttgggcggtttcgttgtagtcgcgtgtgggaggacgtacgggtttgttttaaagttttgggataatagcgttttcgggggataatgaatgcggagttttcgtttttagtcgattttagatgtgtttttattttttttcgttgtagtcgtaaggtaaggaaatattttttttttcgtattgaggaggttgaggagtgtattgggtgttttttttttttttaatttagaattgcgagatagaggttgagtttttgtaaagaatagttttagaaaagttaggagagcgtaggagggtattcgggaggttaggaggggttcgttggggttttaatcgtatttatatcggttttatttgcgagggggcgggatttcgtggcgttggattaattagtatttatttgcgtttatttggttttttttcgttggttttcgggggttgcggtgtttaaaggggtaagagttgagcggaatatcggttcgtcgtcgcggtagttgttttatttttttttttgtagttatggggttttttcgtggatttttcgcgttttttttttttttttaggtattttatagtttcgtcgtggtttcgatcgggatcgttttttggggggcgggcggggttcgtatggggtagtggcgtcggggagagcgcggggttgcgttttttggggttaagggagtttcggaaggttcgtgaggattttgcggtgtggggagtgtagggtcgggtacgtttggatttagttttttttattttttgttttcgggcgtagg

SEQ ID NO: 12 - DNA, 5310 bp, Artificial Sequence
  Chemically treated genomic DNA (Homo sapiens)
tttgcgttcgagggtagagagtgaaggaggttgggtttaggcgtgttcggttttgtattttttatatcgtagggtttttacgggtttttcgggatttttttggttttagggagcgtagtttcgcgtttttttcgacgttattgttttatgcggatttcgttcgttttttagggagcggtttcggtcggggttacggcgaggttgtggagtatttggagaaggaggagagacgcgagaggtttacgagggagttttatggttgtagagagaggggtgaagtagttgtcgcgacggcgggtcggtgtttcgtttagtttttgtttttttgagtatcgtagttttcgggagttagcgggaggaggttaggtgagcgtaggtgggtgttgattggtttagcgttacgaggtttcgttttttcgtaggtgggatcgatgtgggtgcggttgaggttttagcgaattttttttggtttttcggatgtttttttgcgtttttttggtttttttggagttgttttttatagggatttagtttttgtttcgtagttttgggttagaggagaaaagaatatttagtgtattttttagtttttttagtacgggaagagaaatgtttttttgttttgcggttatagcggaaaaaagtggagatatatttgaagtcgattgaaaacggaggtttcgtatttattatttttcggaggcgttgttattttaaagttttgaagtaggttcgtgcgtttttttatacgcggttatagcggggtcgtttaagtttttttttttatttttcgtgttagttcgtcggggaggatttttcggggtataaaattagtaggtttcgaaggatcgcgtttttgaattggatataattttttttttttttttttttttttttttttggagatagggtttcgttttgtcgtttaggagtgtagtagcgcgatttcggtttattatagtttcgatttttcgggttgaagcgattttttttttttagttttcgttgagattataggtttgcgttattatattcggttaatttttaaaaattttttgtagcgatgtggtggggcggggggagggtggagggttattttatgttgtttaagttggttttgaatttttggatttaagcgatttttcgttttttagagtgtttaggttataggtatgagtcgttatattcggatcgttttttttattttatagttaaataaagggaagttagtcgagaaagttttagagtttggaagttgtagtggtgttaaagggtgcgagttaagagggttgttattagttttataatttttagtatttttattttttatataaataatatttttttaattttttgtaaaatgtaaataaagataatttttaaaacgtagaggttttgaaattggtttgaaatattgtatataatttgggtaaaaattgtttgttgcgtaaagtagtttttagagagttttttttggaaaatagtttttttatattttttttaggagataaacgttagatttgggattcgttgtttttttacgttatttttattttattacgttagatacgaagtgttttttttttgttgtatataagtgggttttggttatgaaaacggttttgagttttaattattattttataagtttttttttacggagttgagttttttcggttagttttttttatttgtttttttattttttttttattttttgttgttgttttgagaagttttggatgttattttttggttttttttttttttcgtttttagtttagatttaggggtttgaggaacggattggagattggagaggtttttttgttttgtttgtttttttgagatggagttttattgtcgtttagtacggtggcgttatttttgtttattgtaattttcgttttttaggtttaagcgatttttttgttttagtttttcgagtagttgggattataggcgtttattattatattaggttaatttttgtatttttagtagagacgggatttcgttatattggttaggttggtttcgaattttcgattttaagtgattcgttttttttggttttttaaagtgttgggattataggcgtgagaaacggggtttagtttggagttttaaatgatagattttttgattttttagggttaatttggtaatttattcgttttttttttcgttaggtttgtggttaagttatggattgtttgcgttgcgagggtgggggttttgtttttttaggtttagtatgggtttttaaggtcggttttatttgggtttaaatttaggttttattttttagtagcgttgaagtttcggggaagtaaaataaattttttgggttttagttttgtatttgttaaatggggttgttatgattttagtattttatttttttatagatgagtattaaataaattagaaggtttaaaacgttaaatattatatttggtatatagtaagtgtttaaatgttgtttggtattattgtttttagatgtttggcgagtcgtttttttttttagtatttttatattttttgaattaagagaatgagaagcgttgtaattttttaattttatggttgagggtataacgagtaattggtatttggtatttcgggagtatttttttagtcggcgggtgagtttagtagttggggttgggattgaggttgggggtggattacgcggttgggaaagtttggggttgttcgttgagtttcgcgttttttcggtttggatttttcgtagggcgttttttatgttcgaggggaggttaggtttacgcgtattcgcgcggcgtaatggagtgggttttcggcgggatagggtggttaggtttacgttcgtttcgtaggttttttcgcgttcgttcggagttagacgaagttattaggcggacggttaaatataaacgagtttcgggatgtaggttttaattaagtaaatattcggttggtgggttgttgagcgcgtttattttcgtttttttttcgggtatttagtatttcggacgggggcggagagaggagcggagattggagagttagtttttttgtttgcgacgcggatcgtatcgttgttttttttttagttttttttgtcggttatttatttatttatttattttaaaaatatttgttgatagtcggcgatgtgttaattatttaagatataatagtgaataaatatttttgcgttttcggatttgttatttagagtgtggagggtagaggaaagtgaaaaaatacgtggaaatataatatgttagatggtaatatgtatcgtgtataagaataaggataggggggttcggcgtagtgggtagtggtttacgtttgtaattttatttagaaggttgaggtgggtggatgagtttaggagtttgatattagtttgggtaatatagcgagatttttgtttttataaaaaatataaaaaaaaaaattagttaggtttgttggtacgggtttgtagttttagttatttagaaggttaaggcgggaggatagtttgagtttaggaggttgaggttgtagtgaattatgattatattattgtattttagtttgttttattttttgaggaaatattatattgttttttatagtaattgtatttttttttttttttttgagatatttcgttgttatgtttaggttggagtgtaatggcgagatttcggtttattgtaattttcgttttacgggtttaagcgatttttttgttttagtttttcgagtagttgggattataggtgtttgttattatttttagttaatttttgtatttttagttgaggtagggttttattatgttggtcgggttgattttaaatttttgattttaggtaatttgttcgtttcgattttttaaagtgttgggattataggcgttagagattgcgtttagtcgggaggtttaagttttaaggaagggacgagagaaatgggtagggtttagggagtttagataataggggtgttgaggtattagagagataaataaaagttggaaggtatgattattttgagaattgaaggttagagaggaaattatgttattggaagttcgtggataaggggatagggaagtgtgggatttatttttaaatgtagttgtgatcgaggaaggtatagttattgtttagagtagagtagagaaagtgtagggaaaaaaaatattttagtatttttttttttttgttttttattttttggtggtattttttatttattaaatttatttagaagtttgaggtaagaaagtttaggttgttttttagaggggttattttttttaggtttaggatagggtatagaagggtagaaaatgatgggaattcggagagtaaataagaaagtttagaggttttatttataaagtggtattagaataaagatttgaaggaagtgaaggaattacgttttggaaagagtattttaggtagagaaaatagggtagaggtttcgagatagtagattatttggaatagtaagaaagttagtgtggttggagtagagagagtaagtaggaagtgagttagagtatgggagggttaggattatattttgtagagtatgtaggttattgtaagaattttggtttttatttggggaattaggggaggtagttattgttggttttgagtagaggagtgatgttgagaaaattataagggataagggaagtagggaggttggtgggggttttattgtagttatttaggtaaaagatgaaacggtttggtttagattggttattatggagtgggtttgaaatagttagattttttttttttttttttttgagatagggttttgttgttattttagtaggggtgtagtgtagtggtatgattatagtttattgtagttttaatttgttaggtttaagtgcgatttttttattttatttttttaagtagttggaaataaaggtgtgtgttattacgtttggttaatttttttttttttttttgagatggagtttcgttgtgtcgtttaggttagggtgtagtggtgcgatttgggattattgtaattttcgttttttaggtttaagcgattttttcgttttagttttttgagtagttggggttataggcgggtgttattacgtttagttaatttttgtatttttaatggagatggggttttgttttgttggttaggttggttttgaatttttgattttaggtgatttgtttatttcgattttttaaagtgttgggattataggtataagttattgtattcggtttaattttttaattttttaattttttttttttttttttt

SEQ ID NO: 13 - DNA, 7040 bp, Artificial Sequence
  Chemically treated genomic DNA (Homo sapiens)
atatagtttggtttgagggaagatgttagtatgtgattataaattggataaaattatttaagatagtcgtattttaattagattaaattttaaaattttaaatatttataagtattttatgtttttaaaaatatgagaaatttgtaagatattattaaatttaaaggtttttaaaattagtttgaaatatatttgtatgttttaaaattttttgtgaagtttagttgtatttagataagtaaaattttatttacgtatttttagagttaaaatataaaatttaagcgattagggtaaagtggaagtaattaattttaattttttcgtatggaaatagatagtgtgcgttggttatatttagggacgtgttttatgtaatttataaattaagatttgtttcgattatattatatggattatataaaaattaaagtagttgtatatgtattttattgatatagaaataagtttatgttatattgttaagtataaaatttaaattttagaatgttaatagtataattttattgaagtaaaaaaaaattgatatgttttttaagtttgagtttataatttttgtatgggaatttttagtaaagcgtatatatttatttatagtttaattttttagttttaaaaaaggtaaaagtgaaatttcgataatgaaatttacggttgtaattagtaatattatatttgtacggttgtaatattcgcgtttttcgtattgtaatttttggaatttattgtaatttttcgaattcgttgttattcgagattttttaatttggcggttttttgttaggattcgggcggtcgttaagagtgcgtaggcgtaagcgcggtcgtcgtcggtggggttttatgtgttgttgagattgttgttgagtttttgggtttttttaagattgttttttaaaagacgacgtgatgattttaaagagaaaggaaaatttgttgcgtacgtagaagggtaggttgggcgtattttgagcgtttttcggggatcgacggtttcgtttacgtgttttcgggtattagcgcgtttaaagttcgtgtattaggaaacgtataaaagtattagcgggcgagttcgagggcgagtttacgggtagttaggaggcggcgagggcggtttgttttttagagattggggaattaagaaaggtagagttattttttcggttttagcgtagtaagtgtaggaggtagggagggcgtagcgtttcgtcgtttacggtattcgtggaattcggtgcgcgtttcgggagttggggcggtttaggtttagcgtgtttagaaagttaattacgttggttaggaggacgtttttttattattcgcgatttttaggttttgattaaagttaaattaaaaggagttattcgtttcggtatttgttgttatttttgtgataaatatggtgtttgatacgaaagtattttaatagttatgttgttaattaaagaataaaatacgtaaagtttgtgcgttaagaatacgagagtatttcgttttttaggaggtgtagtttattttgttttttttgttttatatataattttaaggagaattttttgttattaatatattttgttttttgtttttgggggatgatataggtatattgtatttgattagattagtgttaattttttatttacgtttttattatatgttgtattattaatatagtaggattttatatttttaatcgtaaaatttaagagtagaaaaatatttaaattgtatgttagtttaatatgaaaacgagttattttagttttgataggatatttttaaattaatattatttaataaatatgttttttattcgtataagtttatatatatggttttttaaatgagttttataaataataattagtattgaggttttgatttaagtatttgaaattttgttattttttataataattttgagatgggtatattttttttattttgtagataaggaaataggtattgggatggtaagaaatttaggttatttggtttttaatagttttttattattatgttaaagttttatttatttttgagatttaaaatattatatagtgtatatatatttggtaattaaattaggattaaatattaaagttaagggttaagtatagtgttttgtaattttagtattttgggaagttgaggcgggtagatcgtttgattttaggagtttaagattagtttggaaaatatggtgaaattttattttaataaaaaaatataaaaatagttgggtgtggtggtgtgtgtttgtggttttagttatttgggaggttgaggtgggaggatcgtttgagttaaggaggtagaggttgtagtgaattaagattatattattgtattttagtttgggtgatatagtgagacgttgttttaaaaagaaaaaagtaaaattaaagtaagaatataataagaaatatgtttggtattgtgttacggggagaaaaaattaatagggagataaattttgtttttagggtaagtgtaatttgttgagtaaaagaaatattttaagatattttaaaaaagaaaataaaggttgttgtaaattggatatttaattaaatatttttgggtagattggtagatgatagatttaatgaatttggggtttataaatatatagaatgttatatttttattaatattttatgttttgggtaaagagtaaaattaattttgaaaatgaattgtgtatgtaattattttaaaaataaagattatataataagttatattattttgtattatgtgtaatatttagggggttaaggtatttttattttgttaatatttatagtatttttattatataattattttagagttttgaattataattttaattaggtgatagttattgagtaaattttgtaatgtaaatttattatagaatataattgtattattttttttttatttattggtatttttttatatttggggtttgatataattgtatataataatttttttattaaaatattttatagagttggttaggtatggtggtttacgtttgtaattttagtattttgggaggttgaggtaggtggattatttggggttaggagtttgagattagtttggttaatatggtgaaattttatttttattaaaaatataaaagttagttgggtatggtggtatgcgtttgtaattttagttattcgggaggttgaggcgggagaatcgtttgaatttaggtggcggaggttgtagtgagcggagatcgtgttattgtattttagtttgggtaataagagcgaaattttgttttaaaaaaaaaaaaaagattgaggtttaagtaggttaaatattatatatatattagattatatattaagttatataggttgtatagaatagaaattttattttagggttttatagattttaaattgtttttgtaaatggtttatgtttattaatttatttttttaaagttaatatattttaaaaatagaattgttattattaaaatgtggttatatataatttaatatataagtgttttagaagaagggaattttattatttgattttttaaaatatagattttaatatttttgtgtgtgtgtgtttttttatgaatatggtaatattattggttttttttttaaagatatggtatgaaattaattttttgtttagagttaggattttgttttattatttagtttggtgtgtagtggtacgattatagtttattatagttttaaattttttagtttaagttttttttcgttttagtttttaaagtagttaggattataggagtgtattattatatttagttaattttattattattttttgtagaggtaggttttaaatttttggttttaagtggtttttttattttagttttttaaagtattggtattataggtataatttattgtatttggtagaaaattaatttttattataaaaattagaaagaaagattttattgtttgatggttaatattttgaattttattttaatttttggttttttatattatatgtaggtattagtgattttgtgttatttttatttttttagatttttttttttttataatttttttatatgtgttattatttgaagttttgattatagttttgaattatttttatttttttgttttttttaattttggtttaaaatttcggtaatttatttgttacgaagtttagaattttttttgtaagtgagttgatcggttgggttaaatcgttttggaagggaaggattgttaggaagttagtatgttgttaagatgttttgttaatttgttgtgtaagttgtatagagtgttaggggatttttttttttattgatgaatttaggtgtgtgttatgatttgtattagtgattttatttggattgattaaggttgtaattttttatttatatgaatgttgtatttagtttttttttgtaattggttaaataaatgtttgttgtttgtattttaatttttagttaatatttgttggaagtgatttaatgtagttggagaatgatattaataattattatagtttgtaaagtgtgaaataattttattgtgttttgtggtttttttagtttgaggattgataatgtgtagcggatgagatttgaaaaaaacgtattttattataatttaagaaataatgtaaaagaggggtgagttttgaggtagttttatgttgtttgtttggtatgagtttgtttttataagaatttattttaagtgtggaagggaaatgtttttatttgaaagggatagttgtgttttatttcggtttttttttttatttgataaaaatttttgttgagtgatagtatagatgtagtttatttggaataagtgaaggaaaaggagaaaagggatgaggtggagcgaaggagtagttagttatgtttttaaagtttcgcggttttttttagtttttttatttaatttagcggttttggtgtttttttgtaaagtgagatgttttcgtttttggttttacgtttttattttcggagcgagttttttttatcggtggacgcgcggttttgtagtagttttttagagttatttgcgaagttgtttttgggggttatttttttcgggtttcgcggttgtcgcgtcggttggtttggtgttttattgattgggagtaggtgtgtttgttgtagaggttgggagttggagggtttggttcggtgtataaggcgatttatcgcggtgtttttgtggttataaagtaagtgaataagtgtattaagaatcgattagtatttcggcggagtttttgggttgagtttaacgtagtaaggttgcgttacgataatatcgtgcgcgtggtggttgttagtacgcgtacgttcgtagggtttaatagtttagggattattattatggagttcggtggtaacgttattttatattaagttatttatggcgtcgtcggttattttgagggggacgtaggggagttttattgtcgtattggaggatagttaagtttgggaaagtgttttaagtatttattagatgttgtgaacggtttgttttttttttattcgtaaagtattgtgtatttggatttgaagttcgcgaatattttgattagtgagtaggatgtttgtaaaattagtgatttcggttgttttgagaagttggaagatttgttgtgtttttagatatttttttattttttaggaggtatatatatttatcgcgtttcggagtttttgaaaggagagggcgtgacgtttaaagtcgatatttatttttttgttattattttttggtaaatgattattaagtaggcgtcgtattcgggggagcggtagtatatattgtacgcggtggtggtttacgatttgcgttcgttttttttcgttgtcgttttcgaggattcgtttttcgggtagcgttttggggacgttatttagcgttgttggagatttagcgcggcgtagaggtcgagcgcgcggttgtttttggtggattttatttttttgaaagttgaattcggttgattgaaaatttggttaagataagtttttgtttgattttatttgtttttaaaggaagtggagatgtcgaagaaaatatatttgtaggatggagttttagaaaataaagttattaaaaatttttttagtttttagtgttttttttaggatatattagtaaagttataagtttagtatttgttgttttagtattgttagtaattaattttatttatatagttatgtgttttgttttttattgttagtattttatttatttaaatttgttattgataaaagtttgtttaaaatagaattttattgtagaaatgttaaaattttttataaatttatatatattttatatttattatataaattttaattattaatggtgtagttgtttttatattaaattagtaaaaatttttaaaaaaataagtaatgtttttttattattttttttagtaaaattttttgtttgtaatgatttttatttataaaagttatatattgaggtatatttatatttaaaggaattatattataaatgatttattgtaatatttttaatttgtgtattgtaatgagtagaaatattttgttaaaatatttttaaattgggttatttttatttggtattgggatttagaagtagaagataaagattatatgatgtgagaggaaaatgtaggagtagaaggtaaagattatatgatgttaggaattatgaaatttaatatttggatggaagagaatagataaatagaattagattgtttattttagatattaaaataatggatgttggtatataggatttaaaggagaaggtgattggattttgttattgggatagttttgatttttttttagtaatagtagtttttgtgtatggtggaaagtaaggttgatgtaatggttggtagagggaatggtaaggttttgaagtagaggttgtgtatgtattgttaaggagggagaggtaggaagtttaaaagggggttagagatatagaaatgtt

SEQ ID NO: 14 - DNA, 7040 bp, Artificial Sequence
  Chemically treated genomic DNA (Homo sapiens)
aatatttttgtgtttttgatttttttttaagttttttgtttttttttttttaatagtgtatgtatagtttttgttttagggttttgttattttttttgttagttattgtattagttttgttttttattatgtatagaaattgttattgttaaaagaaagttaaagttgttttaatgataaaatttaattatttttttttttaaattttatgtattaatatttattgttttgatgtttagagtgggtaatttagttttatttgtttgtttttttttatttaaatgttaaattttatgatttttgatattatataatttttattttttatttttatattttttttttatattatataatttttattttttatttttgagttttaatattaggtaaaaatgatttagtttagaagtgttttagtaaaatgtttttatttattgtaatgtataagttaaagatattataataagttatttatgatataatttttttgaatgtaaatgtattttagtgtatgatttttatgagtgaaggttattataaataagaagttttattggggggagtagtaggaaagtattatttatttttttaaaagtttttattgatttggtgtgggagtaattatattattaatagttggaatttatgtggtaggtatgggatatatatggatttatagaaaattttgatatttttgtagtggagttttattttggataaatttttattaataataaatttaaataaatgaaatattagtaatggaaagtaaagtatatgattatatgaataagattagttattaatagtattgagataataggtattagatttgtagttttgttaatgtgttttagaaaaagtattggagattaaaggagtttttagtaattttattttttaaaattttattttataaatatgtttttttcgatatttttattttttttaaaaataaatagaattagataaaaatttattttgattaggtttttagttagtcgagtttagtttttaaagaggtgagatttattaaaagtagtcgcgcgttcggtttttgcgtcgcgttgggtttttagtagcgttggatgacgtttttaaggcgttgttcggggagcgagttttcgaaaacggtagcggagagggacgggcgtaggtcgtaggttattatcgcgtatagtatgtgttgtcgttttttcgaatacggcgtttgtttggtagttatttgttagagagtgatggtaaaggaataaatgtcggttttaggcgttacgttttttttttttaggagtttcggggcgcggtgggtgtatgtgttttttagagggtaagagggtgtttggaagtatagtagattttttaattttttagagtaatcgaagttattaattttatagatattttgtttattgattaagatgttcgcgggttttaggtttaagtgtataatgttttgcgagtggaggaagagtaggtcgtttataatatttagtgagtatttgagatatttttttaaatttaattgttttttagtgcggtagtgaggtttttttgcgttttttttagggtggtcggcggcgttatagatgatttggtgtaaagtgacgttgttatcgaattttatgatgatggtttttaggttattggattttgcgggcgtgcgcgtgttggtagttattacgcgtacgatgttatcgtggcgtagttttgttacgttgagtttagtttagaaatttcgtcgagatgttagtcggtttttggtgtatttgtttatttgttttatggttataggaatatcgcggtaagtcgttttgtatatcgagttaaattttttagtttttagtttttgtagtaagtatatttgtttttagttaatggagtattaggttagtcggcgcggtagtcgcggggttcgaggaagatggtttttagaagtagtttcgtaggtagttttgagggattgttgtagggtcgcgcgtttatcgatggggaaaattcgtttcggaggtaggggcgtagggttaggggcgagggtattttattttgtagggggatattagggtcgttggattgaatgaagagattaggggaaatcgcgggattttggaaatatgattgattattttttcgttttattttatttttttttttttttttttttatttgttttaaatgagttatatttgtgttgttatttagtaagagtttttattagatggagggagaaatcggaatgaagtatagttattttttttagatgaaagtattttttttttatatttgaagtgaatttttataaaaataagtttatgttagataaatagtatggagttgttttagaatttattttttttttatattattttttaaattataataaaatacgttttttttaagttttattcgttgtatattattagtttttagattaaagagattataaagtataatgaaattgttttatattttgtaggttgtaatgattgttagtgttattttttagttgtattaaattatttttagtaggtattggttaagagttaaaatgtaaatagtagatatttgtttaattaattatagggaaaaattaggtgtaatatttatatggataaaaaattgtaattttaattaatttaaatagaattattgatataggttataatatatatttaaatttattagtggaaaggagaattttttgatattttatgtagtttatatagtaaattagtaagatattttagtaatatattgattttttaataattttttttttttaaggcgatttggtttaatcggttagtttatttgtaagagagattttagatttcgtagtaaatgagttatcgaagttttgaattagagttgggggagataaaagaatagaaatgatttagagttgtgattagggttttaaataataatatatatgggagaattgtagaagaggaaaaatttgaagaaataaaaatggtataaaattattggtatttatatataatgtagaaaattagaagttggaatgaaatttagggtattggttattagataataagatttttttttttgatttttataatgaaaattaattttttattaagtgtagtgagttatgtttataatattagtgttttgggaggttaaggtggaagggttatttgaggttaagaatttgagatttgtttttataaaaaataataataaagttagttgagtgtggtggtgtatttttatagttttagttattttggaggttggggcgggaggagatttgaattgaggagtttgaggttatagtgagttatgatcgtgttattgtatattaggttggatgatggagtaagattttgattttaagtaaaaaattaattttatattatatttttggaaaaaggattaataatattattatatttatgagaaaatatatatatataaaagtgttaggatttatattttaaaaaattaaatggtaaagttttttttttttaaagtatttatgtgttaggttatgtgtaattatattttaatgatagtagttttgtttttgaagtatattgattttgagaaggtaaattaataaatatgaattatttatagaaataatttgaggtttgtgaagttttggaataggatttttattttatataatttgtgtggtttagtatgtgatttagtgtgtgtataatatttaatttgtttgagttttaattttttttttttttttgagatagagtttcgtttttgttgtttaggttggagtgtaatggtacgattttcgtttattgtaattttcgttatttgggtttaagcgattttttcgttttagtttttcgagtagttgggattataggcgtatgttattatgtttagttaatttttgtatttttagtagagatggggttttattatgttggttaggttggttttaaatttttgattttaggtgatttatttgttttagttttttaaagtgttaggattataggcgtgagttattatgtttggttaattttatggaatattttagtagaaagattgttgtgtgtaattgtgttaaattttaaatataaaaggatgttaatgaatagagaaaaagtaatataattatattttataataaatttatattgtaaaatttatttagtaattgttatttagttaggattataatttagggttttgaaatggttatataataggagtgttgtgaatattagtagaatgagagtgttttaattttttagatattatatataatgtaagataatgtgatttattatataatttttatttttaagataattgtatatataatttatttttaaagttggttttattttttatttaaaatataaggtattagtgaaaatgtggtattttgtgtatttataaattttaagtttattagatttattatttgttaatttgtttaagaatatttaattgaatatttaatttataatagtttttgtttttttttttaaggtattttaaaatattttttttatttagtaaattgtatttattttgaaagtaggatttatttttttattgatttttttttttcgtaatatagtgttaaatatattttttattatgtttttattttaattttgtttttttttttttgagatagcgttttattatgttatttaggttggagtgtagtggtgtgattttggtttattgtaatttttgtttttttggtttaagcgatttttttattttagttttttaagtagttgggattataggtatatattattatatttaattatttttgtatttttttgttgagatggggttttattatgttttttaggttggttttgaatttttgaggttaagcgatttgttcgttttagttttttaaaatgttaggattatagggtattgtgtttggtttttaattttaatgtttaattttgatttggttattaaatatgtgtgtattatgtaatattttggattttaaaaatgggtaaagttttagtatggtggtaaaaggttattaggggttagatggtttgggttttttattattttagtgtttgtttttttatttgtaaaatgaggaaaatatgtttattttaggattgttgtgaagagtaatagagttttaaatatttagattagggttttaatgttaattattatttataaaatttatttaaaaaattatgtgtatgggtttatacgaataagaaatatatttgttaggtagtattggtttaaaagtattttattagggttgaaataattcgtttttatgttaaattaatatataatttgagtatttttttgtttttgaattttgcggttaaaggtataaaattttgttgtattaatggtatagtatgtagtaaaaacgtgggtggaaggttaatattaatttgattaaatgtaatatgtttatgttattttttaaaggtaaagagtaaaatgtgttgataataaggaattttttttggaattatatatgaaataaaggagataagataaattgtattttttgaggagcgaaatgttttcgtgtttttagcgtataggttttacgtgttttgttttttgattggtagtatgattattaagatattttcgtattaaatattatatttattataagagtaataatagatatcggaacggatagttttttttaatttgattttaattagagtttgaggatcgcggatagtgggagaacgtttttttgattaacgtggttggttttttgggtacgttgggtttgagtcgttttagttttcggggcgcgtatcgggttttacgggtatcgtggacggcggggcgttgcgttttttttgttttttgtatttgttgcgttggggtcgaggaggtggttttgttttttttgattttttagtttttggaagataagtcgttttcgtcgttttttggttattcgtgggttcgttttcgggttcgttcgttggtgtttttgtgcgttttttagtgtacgggttttgggcgcgttggtgttcggaagtacgtgggcgaggtcgtcggttttcgaaagacgtttagagtgcgtttagtttgtttttttgcgtacgtaataaatttttttttttttttagagttattacgtcgttttttggaaggtagttttaaaaaggtttagaagtttaatagtagttttaatagtatataaaattttatcgacggcggtcgcgtttgcgtttgcgtatttttgacggtcgttcgagttttggtaggggatcgttaggttaagagatttcgggtgatagcggattcgagaggttatagtggattttagaggttatagtgcgaagagcgcgagtattgtaatcgtgtaagtgtggtattgttggttataatcgtggattttattgtcgaaattttatttttgttttttttaagattaaaaagttaagttgtagatgaatatatacgttttattaaaaatttttatataaagattatagatttaaatttgaaaaatatattaatttttttttattttagtgggattatattattgatattttaaaatttgaattttatatttagtaatataatatagatttgtttttatgttagtaaagtatatatatagttattttaatttttatatggtttatataatatggtcggggtagattttagtttgtggattgtatggagtacgtttttggatgtgattagcgtatattatttgtttttatgcggggaggttggggttggttgtttttattttgttttgatcgtttgggttttgtattttgattttggagatacgtaaataaaattttatttgtttaaatatagttaaattttataaaaggttttaagatatataaatgtgttttaaattggttttggaaatttttgaatttaatgatattttgtaagttttttatgtttttaagaatataaaatgtttatagatatttgaaattttgaaatttgatttgattaaaatgcggttgttttgaatgattttgtttaatttatgattatatattggtatttttttttaagttagattatgt

SEQ ID NO: 15 - DNA, 5942 bp, Artificial Sequence
  Chemically treated genomic DNA (Homo sapiens)
taaggattaggattttaatataaatttagttttttattttttcgggttttttatgtttttttaaattcggtcgttttttatagttttttgtttttgggtttttttttatattttttattatttttttatttcgtatttaagattttatgaaaggtttttttagaaaagaaaaaatgaggagttttgcgatttgaatagtttttttttgttcgtttgtaaatttgaatttttggattttataatagtgagttttttttgtgtttattattcggtatgagtaagataagggggtgggtggtgggagagtggggaagtgtgggaaagaaaagtgtagataaatgggtggaataaagaagtttgatttaaagtttagatttgggggttagagttttggttttagtttaattaagtgtataagtttgataatcgtgggtttttttattatattggttttttttagtaaaattttatttatttttatttttagaggttttgattttttttattattttgtattataatatttgataatatgggtcgggagtggtggtttatgtttgtaattttagtattttgggaagtcgaggtcggcggattatttgaggtcgggagtttaagattagtttggttaatatggagaaatttcgtttttattaaaaatataaaattagttgggcgtggtggggtatgtttgtaattttagttattggggaggttgaggtaggagaattttttgaattcggggggtagaggttgtggtgagtcgagattatgttattgtattttagtttgggtaatgagagcgaaattgtattttaaaaaaaaaagaaaaaaattgataatatggtattttttttttttagttgtgaattttttgagggttgggaatgtttttatttgtatttttggtatatagtatatggatttatgtttgtgaaattagtgaattggttgtagttagggaattttttttgggggaagtgagatttgtacgaagttgggtaatttttggtttaggggggttgaaagaataggtgggggatttttaggagggtttgggatttgaaagtgaatttagattggtagggaggtgattttattatgttatttggagaggttgttttttttgatttaggtgggatttgtatgtggtttttaggtttttgtttggtttttttaaaatagtttttagaaaagtgaataaattataaatggttgatttatttttgatttttagttcgttttttacgaagatagagtttattgattaaaaattttaggatttgtatttgggtagattttaggaaggggaagttaaagggtttaggttagaggtttaagtttagattttagtagtagattagggttagattttattaaagttagaattcgaggtttatgtaagtttttagatttcgtttttaagttttgtttttttttttttttttttttttttttttttagtttagtgtggttattcgagggggttttttttttttagttatagttcgggtattttaagttgggaaatgtgttattcggggttggggtgttgatttgtagtttagttttttttggttttttttgaggatagtggggatgggattggtacggtttttatttcggggttttagttttatttttggtttttagtttttttttagtagtagtttgaagttcgggttggagatgggtattttaagtggaaggttgggaggttgaggattttgcgatagtgatagtaggtgagtagtggatgtgcggtggttggaattttggaagtgggtgttatagttttcgtagtattggagggagggagtaggagatttgtagagaaagaagaaaaagtattaagggtaggggaaggaaaaggggaagagttgaggttttagagggggttggtagggtagaataggatttttttagtttttttgttaaggaataaattgttagttaggtatagtggtttacgtttgtaattttaatattttgggaggtagaggcgggtagatggttttgagtttaggagtttgagattagtttgggtaaaatggtaacgtttgtttttttttttttttttttttgagatggagttttgttttgttgtttaggttggagtgtagtgttatgattttggtttattgtaatttttattttagcgatttttttgtattagttttttaagtagtcgggattataggtatatgttattatgtttcggtaaagtttgttttttataaaaaatatgtttgagtttaggaagcggaggttgtagtgagttgaaattatattattgtatattagtttgggcgatagagtgagatgagtgagattttgttttaaaaaaaaaaaaaaaaaaaaaaaaagggataaattgtttttttttttatttaatagtgagggatttaggttggtttaaaggtggtggtgagttatttgaattaattgtttatttagttatagattaaattttttattttatttttttttttttttttattattgtatttgatttgttttaaaaataaatttttttaaattattgtgggatttagagtagaatagttgaaagaaaaaaatggtaattagatttagtaaatttttgggtaaggggagggatattagttataatgattatagttaatatttatgtattgtatattatgcggtatgtattattttagtattttatatatattaatttattgaattttaataacgatttttattatttttatttttaagatgagaaaattggaatatgtagatattaggttgtttgtttaagtaagtggaattaggttttaaatttagggagtttatgtttataattatttgattatattattttgttaatttatatatgaggataaggaaagaattttttagtattgtgttggggcgtttggtgtggtgtggttgggagaggtagaatataatgagatatgggtttgagttaaagtttttttttatcggtttttcgggttttttgtttttttatggttttttttgattatgcgggttattttagggaagttagtttttttagcgagttgagtcgtatttttgttatttagtttatagatttttatttaggtagttttacggtttaggagatagtttatagttgttttttggttcgttcgagtagtatatattagtggggtttattagaaggtatttcgggcgttgatattttttttagttttttttgttttatgcggttttagtagttttttaagttttggtaggttttttttttgggttgtttttagtattcggtgagttattttatttttagttttaagggattttttttgtttatgtttttttgatgttttttttgttattgtttttgttgttggtgtttttattattttttttttttttttttttttttttttggtaggtttagtttgagatttttgggagttaggagcgttgtttttatttttaattagggttttatagaaagttcgggttgtagttttatttagggtggattttggtttttcgggttgtggttgttgttgtttatttttttagaggtcgttggggttagtggttggggtgaaggtgatgagtaagggtcgggatatggtttttgggagaattgagaaaatgatattaggtaagggaaggatgagataagtaagttaagttcgtggtgattttgtagtaattatagttttagagatttgttgggatgagaaaaagtagttaaaaatatttttttgttattaaagtaattttataatttaggattttgtagggtttaagggagagagattttgcgtaaaaatatggaattttataatatcgattttgttttttagtaaagattaataaaattttatgagattgttgtttagaggttttgcgttcggtttttatttttatttttattaataataaatattagtttttttttgaaattatttttttatttcgtaagatatattagtaggaaaaaaaaattagtttggttttttaagtttttcgcgattttatttcggagttttttttttttaaataaaaatagatgggttattttttagaagatttcggggagagttttttatacgtgttgttgtgtagttttcgtatcgtaaaatggcgttattttaattagaagagttgatataattaaatagttatacggtacgaagacgtatgcgtggcgataataataataaaaattataatttatattatttgagggttcgggcgtgcgtaaagtttcgggtttagtttttcgcgttggaatttttttaatagtaaacgagtaaagtttcgcgcgtttaggtggcgcgagtattaggatttgtcggttggggttttatttttatataacgtttttataatgtttttcgttttttttaacgtggttttcgttttaagtttattttttggagttaggaatttattttgtgggttaggaaaggtttttaggaggcggagggaaatttgtggaatgtcgagaagtcgtgtaatgaaataacgttacgtttgttttttattattattttgattagggttcgaaggttatatttagagtttaaggggaaatggagaagtgtaaagggacgagtagaatggttggtattattttaggttagcgtattgggacgttttagtttttatatcgtttattttattttatttaagtttttacgtacggagttaagtcgtatttttttttttatgaggtaggagttcggaggaaatagtatgttcgttaagggtttttggcgggattgattcgtattaggggtttaataggtaataaggatttagcggattggtcgaggataggttagttttttgggtagtagcgtcgcgtcgggattagaggggaacgtgaggagagttgcggaaagagatttagtttggttttttttttttttcgttttaagttagtttttttatttagtgagtataaaattgtattgtttagattttcgggtttcgaacgttatatttggttttcgttttcggtggtttttcgttgtgtttcgttcgtaagcgttttttttcgggttttcgtgatagttaggtcgtgcgcgggttattttgggattggtagttcgtttttttttatttagttagtttttttttttatcggggatttcgtgtttcggtatttatcgcggtatttgatttttggcgtttgcgtgttgtttttttttttattttttttaatttttattttttttattttatttcgtttgtcgcggtcgggttcgcggtttgcgttgtagcggtcgtcgtcgttttttggaagtagtaatttttttattttattttagttttggttttcgtttagtcggtgagtttgaagtcgtcgttgtttcgagttttttgtcgttgggagcggtatatggggttttcggattttgatgtgggggcgggggaggaagcgattaggttcggtacgaaggagggagaggtggtttgaggagcggaggggggatgtgtggatttcggtgaaagggatttgataatcgtttttaattcgtgagaaaaggaggagttcggtttttgtttgagaatgataaatttggaaatttttgggaaaggcgtgggggttatgtagagatttgtattggtagggagtttgagtcgaggtttttgtcggagttgatatagaggagagagggttttggttttcgggagttttagggatgtgggtcgggttggtgggttaaagtatttgttggttttttttaagtggtgggattttaaagaatgtttaattttaaagaaaaggggttgagatgtaaattagaggagttggagaggagtgttttagagtttgggttgttttaagaaagggtggtttcgaattttttcgtggttggagggtcgaatgtgggaggagggaggatattagaggtagggaaggagaatttgagttttattgatattgttttttttttagt

SEQ ID NO: 16 - DNA, 5942 bp, Artificial Sequence
  Chemically treated genomic DNA (Homo sapiens)
gttagaaaaagaatagtgttagtaaagtttaagttttttttttttgtttttggtattttttttttttttatattcggttttttaattacgggagaattcggaattatttttttttaaagtaatttaaattttgaagtatttttttttagtttttttaatttatattttagttttttttttttgaagttaaatattttttggggttttattatttgaaagaagttaatagatattttgatttattagttcgatttatatttttggagttttcgaaggttagggtttttttttttttgtgttaatttcggtagggatttcgatttaggttttttattaatataagtttttgtatgatttttacgttttttttaagggtttttaagtttattatttttaagtaagaatcgggttttttttttttttacgggttgggggcgattgttaggttttttttatcggaatttatatatttttttttcgttttttaggttatttttttttttttcgtgtcggatttggtcgttttttttttcgtttttatattaaagttcggagattttatgtgtcgtttttagcgataagggattcggagtagcgacgattttagatttatcggttggacggggattaggattggggtggggtagggaagttgttatttttagggaacggcggcgatcgttatagcgtaggtcgcggattcgatcgcggtaggcgaagtggggtggggggagtggaaattagggagggtggggaagagggtaatacgtaagcgttaagggttaggtgtcgcggtggatgtcgggatacggagttttcggtagagaaagaaattggttaaatgagagaaagcgaattattaattttaggatgattcgcgtacgatttggttgttacgaaggttcggaggagggcgtttgcgggcggggtataacgagaagttatcggaagcggaagttaggtatggcgttcggggttcgggagtttgggtaatatagttttgtgtttattgggtgaagaggttgatttagggcggggaaaggaggaagttaggttggattttttttcgtagttttttttacgtttttttttagtttcggcgcggcgttgttgtttaggggattggtttattttcggttaattcgttgggtttttattgtttgttgggtttttagtgcgaattagtttcgttagagatttttgacgggtatattgtttttttcgggtttttgttttatgaggggagaggtgcggtttggtttcgtgcgtagggatttgggtggggtggggtgggcggtgtgagaattggaacgttttagtgcgttaatttgaggtggtgttagttattttgttcgtttttttgtatttttttatttttttttaggttttaagtgtgattttcgaattttggttagagtaatggtgaggggtaggcgtgacgttattttattatacggtttttcggtattttataggttttttttcgttttttgagggttttttttaatttatagagtggatttttggttttagaaaatgggtttggagcgggggttacgttgaggaaggcgaagggtattgtgggggcgttatgtaaaagtaggattttaatcgatagattttagtgttcgcgttatttgggcgcgcggagttttgttcgtttattattgaaaaagttttagcgcgggaaattgaattcggagttttgcgtacgttcgagtttttaagtaatgtgggttgtggtttttgttgttgttgtcgttacgtatgcgttttcgtgtcgtgtggttatttgattgtgttaatttttttgattagaatggcgttattttgcggtacggaagttatatagtaatacgtataggagatttttttcgagattttttagggagtgatttatttatttttgtttgggaagaggaaatttcgaaatgggatcgcggaagatttaaagggttaggttgattttttttttttattggtatgttttacggggtgggaaagtggttttagaaagaggttggtgtttattgttggtgaggatgggggtgggggtcggacgtaggatttttggataatagttttatggagttttattaatttttattaaggagtaaagtcggtattgtagggttttatgtttttacgtaaagttttttttttttaggttttgtagagttttaagttgtggggttattttagtggtaggaaagtgtttttgattatttttttttattttagtaggtttttgaggttgtggttgttatagggttattacgagtttggtttatttgttttattttttttttgtttggtattatttttttagtttttttaaaagttatgtttcggtttttgtttattatttttattttagttattgattttagcgatttttggaaggatgggtagtagtagttatagttcgagaagttagagtttattttggatggggttgtagttcgagttttttatgaggttttgattggggatgagagtagcgtttttgatttttagagattttagattgaatttgttagagaaagaaagagaaagaaaagaagaataatgaaggtattagtagtagaagtagtggtagaaggagtattaggaagatatggataagggagattttttgaggttgaggataagatgatttatcggatattgagggtagtttaggagggggatttgttagaatttaggagattgttggaatcgtatgaggtaggaggagttggggggaatattaacgttcgggatgttttttggtggattttattgatgtgtgttgttcgagcgggttagggggtagttgtgagttattttttgggtcgtggggttgtttgggtgggggtttgtgagttgagtggtagggatgcggtttagttcgttgaagaagttggtttttttgaggtagttcgtatggttagggagagttatggagagataaggagttcggaaaatcggtaaggggaaattttagtttagatttatgttttattgtgttttgttttttttagttatattatattagacgttttagtatagtgttgaagagttttttttttatttttatgtgtaggttgatagggtagtatagttaagtggttataaatatgagttttttggatttaaagtttgattttatttatttgggtaaataatttaatgtttatatgttttagtttttttattttagaaatgggggtagtaagaatcgttgttaggatttaatgggttaatatatgtaaaatgttagaatagtgtatgtcgtatagtatgtaatatatgaatgttagttatagttattatgattaatgtttttttttttgtttaagagtttgttaggtttggttattattttttttttttaattattttgttttggattttataatggtttaaagaaatttgtttttaagataagttaagtgtagtagtgagaaggaggggaaaagtggagtaaggagtttgatttgtaattgagtgaataattaatttagataatttattattatttttggattagtttggattttttattgttaagtaggaaggaaggtaatttgtttttttttttttttttttttttttttttgagataaagttttatttattttattttgtcgtttaggttggtgtgtaatggtgtgattttagtttattgtaattttcgttttttgggtttaagtatattttttgtagaaagtaggttttgtcgggatatggtggtatgtgtttgtaatttcggttatttgggaggttgatgtaggagaatcgttaaggtggaagttgtagtgagttaggattatggtattgtattttaatttgggtagtagagtaagattttattttaaaaaaaaaaaaaaaaaaaagtaggcgttgttattttgtttaggttggttttaaatttttgagtttaaagttatttgttcgtttttgttttttaaagtgttgggattataggcgtgagttattatgtttagttggtaatttgttttttagtagaaaagttgaaaagattttattttattttgttagttttttttgaggttttaattttttttttttttttttttttgtttttaatgtttttttttttttttttgtaggttttttattttttttttttagtattgcgagaattgtgatatttatttttaagattttaattatcgtatatttattgtttatttgttgttattgtcgtagggtttttagttttttaattttttatttggggtgtttatttttagttcgggttttaaattgttgttgagggggggttgggagttaggaatggggttgggatttcggggtgagggtcgtgttaattttatttttattgtttttaagagagattaggaaggattaggttatagattagtattttagtttcgagtgatatattttttagtttgggatattcgagttgtggttgggagggagagattttttcgggtggttatattgagttggagggaggagagaaggagggaggagaaagatagggtttgggagcgggatttaaggatttatatgaatttcgagttttgattttggtaaagtttgattttagtttgttgttgaagtttgaatttgggtttttgatttgggttttttgattttttttttttgggatttgtttagatgtagattttgaagtttttggttaataggttttgttttcgtgagagacgggttgagagttagaaataaattaattatttgtggtttatttatttttttggaagttattttgaggaagttaaatagaagtttgggagttatatgtaagttttatttgagttagaaggggtagtttttttaggtggtatgataaggttatttttttgttaatttgggtttatttttaggttttagatttttttgggagttttttatttatttttttaatttttttggattaagaattgtttagtttcgtgtaagttttattttttttaggaggagttttttgattatagttaatttattgattttataaatataagtttatatattatgtgttaagaatataggtaaagatatttttaatttttaaagagtttatagttggagagggaaagtgttatgttattaattttttttttttttttttgagatgtagtttcgtttttattgtttaggttggagtgtaatggtatgatttcggtttattataatttttgtttttcgagtttaagggatttttttgttttagtttttttagtagttgggattataggtatgttttattacgtttagttaattttgtatttttagtagagacggggtttttttatgttggttaagttggttttgaattttcgattttaggtgattcgtcggtttcggttttttaaagtgttggggttgtaggtatgaattattattttcggtttatgttattaaatattataatgtagggtgataagggaagttaaggtttttagagatgagaatgggtagggttttgttggaagaggttagtgtgataggagggtttacgattattaagtttgtatatttagttgaattgggattagaattttagtttttaaatttaaattttaagttaaatttttttgttttatttatttgtttatattttttttttttatatttttttatttttttattatttatttttttgttttgtttatgtcgggtggtaggtataagaagagtttattgttgtgaaatttaggaatttaaatttgtagacgggtaggggagggttgtttaagtcgtaagattttttatttttttttttttgggaaagttttttatgaagttttggatgcgaaatggaggagtggtgggggatgtggaaaagaatttaggggtagggggttgtagggggcgatcgagtttagggaagtatgagaaattcgggaaaatggggagttgggtttatattaaggttttggtttttg

SEQ ID NO: 17 - DNA, 18997 bp, Artificial Sequence
  Chemically treated genomic DNA (Homo sapiens)
atatttggtgatttttgtatttgatggattagttggtattatttagattgatgaattggtttatttgattttgtagcgttttttatttaggaatttagggtaagaagatagttttgattttttatgattttattttcgattattaggattcgtggtttattggtttttttaattaagttgtttttaaaaattttgattttcgaatgtttggggagattgatttgagtaataataaaatttcgtttttttgtatagttggttgtgtatgaattattttttttttattttaattgtttagttttgatgaattagttttgtttaggtagcgggtaaggtgaattttttgggaggttataaattttttttttatgattgtaagttattattgagtattttaaaagtaggtggagttgataaattgatagtttaggtttggtagttatagattatttttgttttaaatgggtattattgttatttgaataaattgtgaataaggtatatttttttgattgaatatagaaatgagtggaatagtttataagttgttttgtttaatgatagttattagttataagtggttatttagatttaaataaaagttaaataaaatttttttagttatattgtaattaagtatttttatttttttaagagatagtttaatgatttttaaaaaattttttttttttttttttttttttttattttttttttagttttttagaaatgtaattgtagttttttattttttttttattagatattttttatggggtaggtttatttaattatgtgtttagaagttttagagaggaatttttatttatcgggaggttgttttgagagataatagtttatttataatttaaagtatgtttgttataaagtttttttttatttggagagttttggttatttttataatttagttttgtttataaaaggtattagtagttattgtttagtagataaggtattgaaggtagtatgtagattttttaattattcgtttttttttttcgtgttatttatgttagtattttatgttttattttaaaagtattttttttttgttttaaaagtgaaatggtatttttaaggtagaaaattagtatttttttttttaaggtagttttggaataaaatattattttttttatattagattttatttttgttaagtggattttgtaagtagcgagagagtgaatttgtatttgggttataatattaattagtttaagtgtttaatagttatatatgtttagtagttattatattgggtagtgtagagatattgttatagaaaattttattgtatattgttgtttaggtattgatgattttagttttatgttgtggtgagtgatttgtttttggaaaggataatatagtggatttattttcgggtgttagtaagggggtaaaattgaggtttttttgagatttttaaatagttaggagggagggaaattagataaaggagttgaaaagttgttttattttattagaaattgaaaggatgaagggatatgggtttattgaagatatttattgttttattaggatttgattagaaatttgatattttaaaaatttgattttgtgttgtttgtaatttgattttttttaaatttttatttttgaaaataataatttattttatttgttttattaggaaataaggagagggggttttggttatattggggttaaagtttagaaggtagagattatatatgtaatagtagttaatagaagtaaagaggggaattttaaggtaaacgtgataatgtaagggaaaggaaatggaaaagatatttttttttatgcggagattttttttagaagagttattgtttatttaaattttggaggatttgtgttttttttggtaaataatgtgatttttttttgtagaggatgtatgatgtaaaattatggattttgtttttaagggaatttttttgtttttttatttttttattgttttatgtaatgaaatttttaaagtatattttgattttagttttagtttataaattagatttgttttttaagagttatttgagttgtagtttttttagtgttattttttgtatatttaaattattgggggcgttgtagtttggttaatttttaattatttagagaattaggagaagtagatatggttaattattaggattaatgatagttaataagagtaaatatttattgaatatttattgtttgttaaatattatgttaatagtttaatgtttaatattattttatttaatttttatataattttaatgagttaggtattgttatttttgttttatagaaaaggaaaatgagattgttagattgagtaatttgttttagattagataattagtaaatagtagaattaaggtttaaatttaggattgtttgattttagagtttgtatttttatttattattttggataagaattttaaattatattaatattttgatttaaattaattgaaattaatattagtgttagtaattttttattgatagattagttaaaaatgttttaatgattatagaattataaattgaatagagaagtaggtttttttttgttgttttaagtagtttagaaaagttttagtgtagtatattggtgtgattagtaggttttagaaataaatgtatttaataagtttatttggtgttttttattttttttttttttttgtgagagtttttggggagattttaatgatgatagttgatatggattaaaggtagataaaatataagggagaaaatattggaaggagtttggttgatggaatagaaattttttgaagaatttatatttgaatgattaaaaagtattagtttagtttgtaaagtttgaagttgaatattcgtgaggaagttatttttttatttgttgatgaggtagagagaaaggtttaatttgttagagaaattgatgttttttgttatattatattgaaataagaattagtttgttatttatttttttttttttttttttagtaatataggtttaggttgaatttatgtttatatagttgtataaatttttacgggtatgaatataaatttatttatttaaatagattttaaaggttttttaggttattttttttttttttagaatttaagtaaggttttgattattattgataatatattcgttagttaatgcgtgtagagtttttagtttaaaggtaaataaaaagtgaaaaggggtcggcgtagtggtttatttttataattttagtattttgggaggttgaagtaggtagattatttgaggttaggagtttaagattagtttggttaatatggcgaaatttcgtttttattaaaaatataaaaattagtcgggcgtggtggtaggtgtttttaattttagttattcgggaggttgaggtaggagaatggtttgaatttaggaggtggaggttgtagtgagtcgagatcgtattatttattgtattttagtttgggtgataagagtaaaattttattttaaaaaaaaaaaaaaaaaaagtgaaaaggtaggaacgttgttgtttatttgttgttttaggaattttgtttacgtatagtttaaaatattaagaagttgaaaataaagtatttggttatgtgtggaaaaatttatagttaaaaggtgagatgaattgggtttagaaggtcggatttacgtgaaattaaaagggtaacgaaagttagaatttaattttttaaaaaaagttaaaataggtcgggtgtagtggtttatgtttgtaattttagtattttgggaggtcgaggttggcggattataaggttaggagttcgggattagtttggttaataatggtgaaatttcgtttttattgaaaatataaaaattagtcgggcgtggtggcgcgtgtttgtagttttagttattagggaggcggaggttgtagtgggtcgagatcgcgatattgtattttagtttggtcgatagagtaaggtttcgttttaaaaaaaaaaaaaaaaaaatagttaaaatttttaaaataattttatttgttaaaatataaaatttgaaattattttagttttttttgtaaaatgagttggagagagtagggttgaattaggtatgttttttcgggtttttcgacgttgatatttcgggatattatattaggtttaagatattagtttgcggaaagagagttgttaaatttgattatatgttttttgtacgatattcgatagttgtttttttttttattagtttttttaaggttgtaaatatatttgatttacgtgagagtttttataagttagtataacgttaggttttaaggaggcgtttaataaatgttggtattgtagggttagatttcgagttttagtttagaattttgttgaggttaggttttttttttgtttttcgttttttattatatttatttatttttttaagtaattaagtttaaattggggtttgtgtagtgattggtcgcgtcgggttttattgcggatgaatttgatttgttttaatgatttgtgatagatatttgtagatagcgtttttaatagaattagggttaggttggtattaaattttaggaacgttaggtattgttttaaagtagatgtaaatcgttaaattttttaggatttagaaggattagagagagtcggatatttttggttagttacgcggtttttagtaaagtttattttttttttttttttagtgtgttttgttgttagagtaattgtgggcgttatcgagttgacgggcggaaatagaatagaaagagtatacgtttttagtttattgatagggttattgcgtagacgtattaatttttttgagttgtagttgagtttgttgatgtagttcgcgtttgcgtattagttgttacgcgttttggtcggttttagcgtttgcgtaaattggtatatcggggagggcggagttaggttacgagggtgcgtatgcgtaaatagtatattcggtgtggtcgacgggttttttaagagtttggggcgcggattggagtattttgcgtgtagttatgtcggcgtcggtagtgtttgttatttcgcggtttttagaagagtatttgagttttatttcgtagcgtttgaagttgttggacgcgtatttgttgtatatattgttgatcggggcgttgtagttcggttattgttttttcgtggggatttttttttttaatttttttttttcgggttttattttttgtgtggggagttttattttagcgggtaatggttttataagtgattataataataatgtgttattttggtgtgttgtttttgtttttatagtattttatattagattatcgttttttgaagttatgagaagagtttgtattgtttttttgttgtgaatggggaaattgaggtttagaaagtttagattatatgtttaatattaaacggtttcgtaggagttggatttaaaagtttaaagaaattattttcgtgtcgttattttatttggtgatttattttatttaatattggttcggggaaaattttattttaattttaatttaggtttaatataattttaaaattagtagattttttaaatgaaaaatttaattttgaattatttttgttattttggtttaattattattaattttcggtgaaacgttttaatgaaagtgtaaagaatataaatattggtgttttttttgttgaattattttttatttgattttgttttttagttgttattatttttttttttgttgaggaagttgttattttattgttttgaatttaatttttgtttatataattttattttagttttatttttttttttgattttaggatttggtaattttgtagattgttatatttagcgagaatagtttttattaatttttgttaaaatttgattttttttgtttaacggggatttagtgaatattgaaaataggcgtggtttttattattggtattatttgttattttgattttgaaaatatgttagtatttatggtttttttttagtgtgattattagttaggttattagttgtatttttagtttaatatgaggtattatggtaaaagttttggtatatgttttttattcgtaaagagtttatggtttagttggggtatagataaaatatagtattggaattgtttggaggtttggtatagtggtttatgtttgtaattttagtattttgggaggtcgaggtaggtagattatttgaggttaggagtttaagattagtttggttaatatggtgaaattttatttttattgaaaatatataaattagttaggtatggtggtatatatttgtaattttagttattcgggaggttgaggtagaatcgtttgaattcgggaggtggaggttgtagtgagtcgagatcgtgttattgtattttagtttgggtgagagtgaggtttagttttaaaaaaaaaaaaaaaaagtttggtgatagtggtgttgtgtttaaagttatagatttatagaatgtttattgtatatttatattgttttgatatattagagatattttttagaatttaaaataggtttgaggatttaatgatttgtgtattgaagttgtagattagttttttgattggatatttagttattatttttgatttttgttttagatgattaagatttagttgtttgtggtggcgtttttgtttttaggatgtgttaattattattcgattagatatattatttttttgttttaagtattttttattatttatttatcgttttttgttacggtattatatgtttttattagttagttcggagaaggaattttgatgagaatttttgatttaattttgtttgatgtttttgtttttaggtttggaagagtaggagtaaggtagggtttgaaagttgattttaaaaaagatgttttttttatgtagaagttattttgtttttataagtttttagggtttagaatgattttttatggatgttttgaagaatgtggtttgttgaagagtgggtatggattagagttatagattattagtgtaataaagttagaaggtttttttgagtaaatgatttttatttatgttaagatttgtttttgagttcgttgtggttgaaattgaattggtagattggattgttttttttttttttagtgggaattaggtggtttgttattgaagaaaaatttagtaaaagggtatattagtaatggggttaataagggggattaggatttttagatttgttagataatagataatagagttatagaaatgaaagtaattttaagaaaagaagggatttatgataatttttagttgttatagaagggtatgatttattttttttttgatagtattgatttttttaaattttgttttttttgttatttgttagtttagattattaattggagattggttttaatgggaaatttggacgtttattttttgttttgattgttggtaaaggtagttttgtttttttttatggtgttggggtttttaatttttttgtggaattttttgttgtaagagaatggaggagtttagtgagttgggagagggaaatgtaggcgatattgttgaaggattaggtagtgttgggtgttagatgtttgaatgttaggttaaggaatttggattttttttgagatggagttttgttttttttttttaggttggagtgtaatggcgatttcggtttattgtaatttttgttttttaggtttaagtaatttttttgttttagttttcgaagtagttgggattataggtatgtgttattacgttcggcgaattttgtatttttagtggagacggagtttttttatgttggttaggttggttttaaatttttgattttaggtgattcgtttgtttttgttttttaaagtgttgggattataggtgtgagttattgtgttcggttaggaatttggattttattttgtaggtaatagtaaagtttttgaagatgtttttttttttttttttgagacggagtttcgttttgttttttaggttggagtgcgttatttcggtttattgtaagtttcgttttttgcgtttacgttatttttttgttttagttttttgagtagttgggattgtaggcgtttgttattacgtttagttaagtttttgtatttttagtggagatagggttttatcgtgttagttaggatggttttgattttttgatttcgtgattcgttcgtttcggttttttaaagtgttgggattataggcgtgagttattatattcggtattgagggtgtttttttaaagaaaggaaaagatttaaaattggtgttagtatgtaggatgaattggagggaaatgttttttaattttttttatttttttttggtagtttatttttttttattttttttgtatgtgttagtttagtatatgttttttggaaattgattagtatattttaaattaatttagaacgttattaaatttttaaaaaatttgttgttattgggtttgatggtatgaaaatagtttgtttttttttatttttttatagttgagagatttaattatggttttaagaaggaattagaggtagaaagttgttattgagagatttttttttgtgtgtgttttggattattagagtataatatattggttttaaaaggattttagaggtagaatatttttttatttgagatagattttaaatatttagtagttgattgtttattttgtagttagatatttttagaagaggatatttgttttttttttagagttatattttagtgttggtaattttttagtttttttttttgtttaattgaaagttgtgtttatttaaagtgttatttaggagggataagtagaaaatattaagattgtttttaaaataagtttttggttttgaaataagttttaatttattttttaatttttatttgttttgttttttaatttatatgaggtaattttgttttaaaaaatagttttgttttttttagtttataaatttaaaattagtttgaatttgtaaggtaaggaggtttagtttagagttttttgttttacgggagttattaggttgttgtggattggggtttagtattttttttggaattatttattagatttgtggattttaatattattttttataattgttattcgagagattagaagtttgttatttatgtgtttgatagttttgtttttaaatattttttatattattgttatttttttattttttgttttagttttttaatattttttatgaagattattgtaattttttttattggtttttcggtttttggtttttagtttattttttattgtgtttgtaggtttgatttgatttgtaaatttgattgtgttatttttatgtataatttgtgttttttaaagtaaaattaaaattttttttttgatatataggtttttttatgatttggttttttcgttgtttgtagttttattttttgtttttgttttttttatattttgttttaatagtattgagttatttgttattttttgaatatttttatgtgttaaattatttgtttttgtttgattgtttttaaaatttttttattttttagattttttagtttaagtgtaatttttttttttttttgttattgtttttaaagagaataaggttttgttatgttgtttaggttggttttaaattttttggtttaagtagttttgttttagttttttgagtagttaggattataggtatatagtattatgtttggtttattgttttttggaatttttttttgattttttagtagattgaggttttttttttgtattttttttttattttgtatgtgtgtgtgtgagagagatatggtattgtgttgtatttgggtgtttgttttttttttggaaggtgagtttttgagggtaggggttgtttttttatttttttatttttagtgttgaatattgtatatgttaaatggtgagtaggtttatagttatgttaggaatagtgagtaatgatgtgttaggttttttgttaaggtgttgggaatttaattgtgaagtatatagacgtggtttttatttttatagagtttgtaattagtgggaaatatagataagtaaatatggatatggtgttgatggagaattattggtgagaatgggaatataatgtgtatttaattttgtttagtggttttgtaataatattttttttatatattcgtttttttaaagtaggttttataaattattttattttttttttttttttttatttttagttggtgattttgtttttatttttttattaaaaaaaagaagtagataagaatttttttatttttttattattgaattataatagattatttatttttatatttatattttttgattttttatggtggatgatgtgttttttttttgtgaaagttttgtttgtgtagaggatttagtttttttttgtttatttagggatttcgtttttgtaattatttttttgtttcgtgttattaatttttgttttttttttggattatttttattatataaatatgttttaatattgtttatttaaaaaaaattcgtttgattatagataattttttagttattattttattttttttttattattatagaattttttgaaagaataattaatgtttttatttttttttttaattatttattttttaatttatttttggtattggtttgttttcgttattttattgaattattttattgaaattatttttgttatgttgtaacgtttagtatttaatgtaggtattggtttttgtgtaaaaggaaagtttttttttgaatataatatttttttgtttgttttgttttattttattgtttttttttttttgttgttttgtgttgggcgtttttttgattgagagtatggttgtagatatttttattttgtatttttttttaaatagataaatttaaataatatttgtatatttataattatttttttatatttttagttttgaattgtttttcgaattttaaattagtaaatttagttgttaatttgatgtttttatttgatgtttgatatgtattttgaatttaatatgtttaagattaaatttgtttatttagttatttgtttttttattagttagtacgtggtgttaatgttggttgtggttttttttttttttttttttgagatatagttttattttgttatttaggttggagtgtagtggtataatttcggtttattgtaatttttatttttcgggtttaagtaatttttttgttttagttttttgagtagttgggattataggtacgtttttttatgttcggttaatttttgtatttttagtagagacgaggtttcgttatgttggttaggttggttacgaatttttgattttaggtgatttatttatttcggttttttaaagtgttgggattataggcgtgagtcgttatgttcggtcggttgtgtttttaaatgaagaaatttaagttttcggggttttttgattttttttattttttgtatttgttttattagtaagttttgttttttttaaaatatagtttgtatgtttttatttttgtttatttttattattatttttttgagttttttgggttttaagtaatttttttgtttttttttattttttatatttttgagacggagtttcgttttgttgtttaggttggagtgtagtggcgcgatttcggtttattgtaagtttcgtttttcgggtttacgttatttttttgttttagtttttcgagtagttgggattataggtattcgttataatgatcggttaattttttttttttttttgtattttttagtggagatgggttttattatgttagttaggatggtttcgattttttgattttgtgattcgttcgttttggttttttaaagtgttgggattataggtgtgagttattgcgtttggtttatttttatttttatttttatttttttgagacgtagttttattgtgtcgttaggttggagtgtagtggcgcgattttagtttattgtaattttcgtttttggagtttaagcgatttttttgttttagtttttttagtagttgggattttaggagtttgttattgtattcggttaattttttgtattttatttttagtagagatggggttttatttttttgattaggttggttttgaatttttgattttgtgatttatttatttcggttttttaaagtgttgggattataggcgtgagttattgcgttcggttttttgtttttttttaattttgcgaattattatattgttttatcgtttttataattgaatttatattgttttttgaggtttattatgttttttaggatttggtttttgtgtttttttttttgattattatagttttgttggtttgtttttgatttttttttttttttttttttttttttgagatggagttttgtttttgttgtttaggttggagtgtaatggtacgatttcggtttattgtaattttcgtttttcgggtttaagcggtttttttgttttagttttttgagtagttgggattgtaggtatgtattattaagtttggttaattgttttgtatttttagtagagacggggtttttttatgttggttaggttggtttcgaattttcgattttaggttatttattcgtttcgattttttaaagtgttgggattacgggtgtgagttattatgtttggcgtttgtttttgtgtttataatatgttaagattgtttttattgtttagaatgttttgtttttagatttttatatggttggttttttattttttaaatattggttttaaatagtaagtttttaaagagattttttgttatgattgaatttaagaaaagttttttagttattttttattattttgttttattttttttatagtatatatttttatttagtagtttttggtttatttgttaatttattgattatatgtttttttttataggagtgtaagttttttgagagttagattgttttgttttgtgttatatttttagtatttgaaatgatgtttgttatgtagtagatgtttagtaaatattttatggaataaatggatatttaaggggatagagtaaattagaattgttaaaatggaatagattgtttgaagaggtagtaaatttttatttttggaagtgtttagggagagattgaaggattattggtagtggagtattttgaataggtttttttttttgttttttttgtttttaatgtatttgagagatgtgatatttttattagtaatataggttttggaaagttgataattttttatttggaggtggtttattagattttgtaagtggtgagtatattttggaaagttttttacgtgattagtacgtttttttaagtatggttattttttattattttttgggtattgtatatattaaatggggtgttggtgtttatgatttttgaggttttttttaattttgtgggattttgatttatatgtttttattgaaataatttggttattatgattataataataataatattaatttattattttatttatttttatggataattttttttttttttttttatatttttttaaaatttaatatcgtgttttttattttaatgattattattaatagttttttatttttttagatttttttttagattttaattgaaatgataagataattatgtatattattatatgtaaataaaatattttattttttttttgagacggttttgatttgttttttaggttagagtgcggtggtatgattgtggtttattgtagtttgtaatttttattttttgggtttaagtaatttttttattttagtttttcgagtagttggggttataggtgtgtgttattatatttggttaattaaaatattttttttgtagagatagggtttttttattttttttaggttggttttaagtttttgggtttaagcgatttttttattttggttttataatatgttggggttatagttgtgagttattatgttttggttaagtgaaattaggaatgggttgggtgtgggggtttatgtttgtaatttttatttttaggtaagtagaggcgggaggattgttgggtaatatagggagattttgtttttattaaaaataaataaaaaaattagttaggtatggtggtgtatgattgttgttttagttatttagggggttgaggtgggaggattgtttgagtttaggaggtcgaggttgtagggagttatgattgtattattgtattttagtttgggcgatggagtgagattttgttttaaaaaaaaaaaaaaaaaaaggattggtttttttttatttaataagttttagatatgtttgttgttaatgtatagagaatttattttatttttttgaataattgtatgggattttattgtatgttagttgtatagtttaatttttttgatgtttagattgttttaattttttttttaattttataaatatatttttagaatgtttttgttttgtaagataaatttttttgttaaaaggtaaaattattttaaatattaatggatattgttagttgtttttttaagtggatgaatgaatttgtattttttatagtaggggtttatattggttatttttgttttagttattgtttttaatatttttaagggtttggatatttgaaaggattaatggtgtttttatggtgtttatatgtttaagtataatgaaaattgttgttatggtgataggttttggagaattagtttgatagttttttggtttttggattagatttgtttgttgtttttttttagttaatgatgggatgatgttagtttgaagcgagtttaggtttttttaagtaatgtaataatttattataggtataaagatatttcggaagagtgtatttttggaattgtttgtttttttttttttgttaatggtgattgttagaatttttaaggggatggagtgtggtagtggagagtttttatgaattattttttttaggttttttgttttttttgagataaataagtagttgttagaatttcgagattaaagatagtttatcgagaattgtgaggtttttaagaatgagcgtgttatttttataaattttgttatttattaaatgaatattttattagaaaataatttatatttttataattttttattatttagttcggattttttgttgttgttttaagtgtatttttatttaggtataattagaaatttttaaattagtagataagagagttttgtgggttttttggttatatatttttttttttgagaaagtttttaggttttagtgtaattttgagaagtaatatttttttttttttaatagagtgcgaaatttaattgtataatttgataaatttttaaatgtatttgtttaattattatttagattaagatgtaggatattattagtattatagatgtttttttgtatttttttagttattttttttttgtgaaagataaaaattattattttgttatagattggttttattaagttttaagttttttgtatatggaattatatagtatatatttttttgttttgttttgttttgagacggagttttttttgtttaggttggagtgtagtggcgtaatttcggtttattgtaatttttattttttgagtttaagtaaatttttttgttttagttttttgagtagttgggattataggtgcgtgttattatgtttagttaatttttgtagtttttattagagatggggtttttttatgttggttaggttggttttgaatttttgattttaggtgatttatttattttggttttttaaagtgcggggattataggagtgagttatcgtgtttggtttttgttttattttttaatttttttttttttagatggagtttcgtttttgttgtttatgttagagtgtaatggtacgattttggtttatttttatttttatttttattaatttttttgttttattgttttagtttgttaagtaattgggattataggtatgcgttattatgttcggttaattttgtatttttagtagataaggggtttttttatgttggttaggttggttttgaattttcgattttaggtgattcgtttgtttcggttttttaaagtgttgggattataggcgtgagttatcgtgttcggttttttttttgtttgtttttggttaagataaaatatgataaaatttattattttaattatttttaagtgtatagttttgtggtattaagtatatgtatattgttgtaaaattattattattatttatatttagaatttttttgtttttcgtaattgaaatttagtttttattaaatagtaattttttatttttttttttgttagtttttggtatttattattttattttttgtttttaggagtttgattatttttgatgttatataagtgaaattatatggtatttgtttttttgttatggtttatgttatttaaaataatgtttttaagatttagttatgttgtagtaggtattagaatttttttttttttaaggttgagtattttattgtatgtatatattatattttgtttattcgtttttttgttgatatttgggttgtttttattttttggttattgtgattaatgttgttatgaatatgggtatgtaaatattgtttgagagtttggttttattttttatttttttaattttttagatggagttttttttttgttatttaggttggagtgggacggagtgatgtcggtttattgtagtttttattttttgggtttaagcgatttttttgttttagtttttttagtagttgggattataggcgtttattattacgtttagttaatttttgtatttttagtagagacggggttttattatgttggttaggttggtttcgaatttttgatttcgggtgattcgtttggtttagttttttaaagtgttgggattgtaggtgtgaattattgtgtttggtcgagattttgtttttattttttttggatatgtatttagaagtggaattgttggattatatgatatggtaattttgtttttaatttttttgaggaaacgtagtattgttttttatattggttattttatttgatttttttatttgttagtgtataagggttttagtttttttgtatttttgttaatttttgtttttttgatattagatattttaatagatgtgaggtgatatttcgttgtaattttgatttgtattgttttagtgattaatgatgttgagtatttttttatatgtttgttggttatttttatattttttttggggaaatgtttatttaagttttttgtttattttaaaatttggttattattttgttgttaattgtattgtaggggtattttaatatattttgatattaattttttattagataagtgatttgtaaatatttttttttatttcgtaggtgtttttttattgttgtgttttttattgtatttttattatagaagttttaaattttgatatagtttaatttatttatttttattttgttgattatatttttggtgttatatttaataaattattgttaaatttaatgttataaaatttttgttttgtttttttttaagagttttttagtttttggtttttatttatttcggatttaggtttttgattcgtttcgagttaatttttgtagtatatggtataaggtaagggtttagttttatttttttgtttatggatatttagtttttttagtatcgttggttgagaagattgtttttttattgagtggttttgttagtttggttgaaaattatttgattttgtatacgagggtttttgtgtgttttttaaaaaataaagtaattaaattgatttattttttaattgtagtaaatgtatttttaaaataaatttataatggaaaatttgaattattatttttaaatagaaggttatattaaaaatattatggagttaggtagatgtgtttattcgtgtttgtggttttagttgtttaggaggttgaggtgggaggatcgtttgggttttagttcggtttgggtagtattattagattttgttttttgtcgagtttttagtggttttgtgtggttgtattttagaatattttttatttaattgagggggtatatttgtttttttagtatatatatttaggttttgttttgtggtttttgtgtgggagttgggtttttttgtttttggttttttttgggtatttgttaggttttagttggtttggttagttagtgtgtattttttaagttttgttcgggtacggtggtttatgtttgtaattttagtattttgggaagtcgaggtaggtggattataaggttaggagttcgagattagtttggttagtatggtgaaatttcgtttttattaaaaatataaaaaattagtcgggtatggtggcgtatgtttgtagtttcggttatttgggaggttgaggtaggagaattgtttgaatttagtaggtggagattgtagtgagtcgagattatgttattgtattttagtttgggtgacggagcgagattttgttttcgattttttaaaaaataaagtttttgattgtgttgtttaatttatttgtgtaatttatttatttttgtgtatagtagaagtttttttttattgtagtataatattttattgtttgtatatgttataatttatttattttattgttgatagatattagattgtttttagtttggggttatttgggtattatttttgtgtatgttttttgatgtatatatgtatttatttttgttagagtagaattgttgggttttcgggtatgtttgtgtttattagtatatttattttatatttttatataattatttttttgtgttttgttttttgtgtagt

SEQ ID NO: 18 - DNA, 18997 bp, Artificial Sequence
  Chemically treated genomic DNA (Homo sapiens)
attgtataagaagtaaaatataaaaaaatgattatatagaagtataaaataaatatgttaatgaatatagatatattcgaggatttaataattttattttaatagaaatgaatgtatatatatattaaagggtatatatagaaatgatatttagatagttttaaattggaaataatttaatgtttattaatagtaaaatggataaattatagtatatataaataatagaatattatattgtaatgaaaaagaatttttgttatatataaaaatggatgaattgtataagtaagttgggtaatataattaaaaattttattttttggggagtcggggatagagtttcgtttcgttatttaggttggaatgtagtggtatgatttcggtttattgtaatttttatttgttgggtttaagtaatttttttgttttagttttttaagtagtcgggattataggtatgcgttattatgttcggttaattttttgtatttttagtagagacggggttttattatgttgattaggttggtttcgaatttttgattttgtgatttatttgtttcggttttttaaagtgttgggattataggtatgagttatcgtgttcggataaaatttaaaaaatatatattggttggttaaattagttggaatttggtaggtatttagaggaagttaaagataaaaaagtttagtttttatatagagattatagggtagagtttaagtgtatatgttgggggaataaatgtatttttttaattagatgaggaatattttgggatgtagttatatagagttattgagaattcggtaggagatagggtttggtggtgttgtttaggtcggattggaatttaagcgatttttttattttagttttttgagtagttgggattataggtacgggtgaatatatttgtttagttttatggtatttttagtgtgattttttatttagggataatgatttaggttttttattataagtttattttaaaaatatatttattatagttaaaaaatgaattaatttaattgttttgttttttaagaaatatataaaaattttcgtatataaaattaaatgatttttaattaaattgataaaattatttaatggggaaatagtttttttaattaacgatgttgggaaaattggatatttataggtaaaagaatgaagttggatttttattttatattatatattataaaaattaattcgaaacggattaaagatttaaattcgaaatggataaagattaaaaattaaaaaatttttagaagaaaatagagtaaaagttttatggtattggatttagtaatgatttattggatatgatattaaaagtatagttaataaagtaaaaatagataaattggattatattaaagtttaaaatttttgtgataaaggtataataaagggtataatagtgaaaaggtatttacggaatggggaaaaatatttgtaaattatttatttgataaagggttaatattagaatatattaaagtatttttataatgtaattaataataaaataataattagattttaaaatgggtaaaggatttgaatagatatttttttaaagaagatataggaatggttaataagtatatgaaaagatgtttaatattattaattattagggtaatataaattaaaattataacgagatattattttatatttattaggatgtttagtattaaaaaaataagagttggtaagaatgtagagaaattgaaatttttgtgtattaataagtgggaaaattaaatagggtagttagtgtgaaaaatagtattgcgtttttttaaaaaaattaaaaatagaattgttatattatataatttagtaattttatttttgggtatatatttaaaagaagtgaaagtaggatttcggttaggtatagtggtttatatttgtaattttagtattttgggaggttgaattaggcggattattcgaggttaggagttcgagattagtttggttaatatggtgaaatttcgtttttattaaaaatataaaaattagttgggcgtggtggtaggcgtttgtaattttagttattagggaagttgaggtagaagaatcgtttgaatttaggaggtggaggttgtagtgagtcgatattatttcgttttattttagtttaggtgataagagagaaattttatttgggaggttgggagggtgggggatggaattaggtttttaagtaatatttgtatatttatgtttatagtagtattagttataatagttaaaaggtgagagtagtttaagtgttagtagaagaacggataagtaaagtgtgatgtatatatataatggaatatttagttttaaaaggaaggaaattttgatatttgttataatatggttgaattttgaggatattattttaagtgatataagttatgataaagggataaatattatgtggttttatttatatgatattaagagtagttaaatttttagaaatagaaagtggaatggtagatgttagggattgatagagaggaggatgaggagttattgtttaatgggaattgaattttagttgcggaagataaaaaagttttggatatggatagtgatgatgattttataataatgtatatgtatttaatgttatagaattatatatttaaaaatggttaaaatggtaaattttgttatgttttattttgattaaaaataaataaaaaaaaggtcgggtacggtggtttacgtttgtaattttagtattttgggaggtcgaggtaggcggattatttgaggtcgggagtttaagattagtttgattaatatggagaaattttttgtttattaaaaatataaaattagtcgggtatggtggcgtatgtttgtgattttagttgtttggtaggttgaggtaatgaggtaggagaattggtggaggtggaggtggaggtgagttaagatcgtgttattgtattttagtatgggtaataagagcgaaattttatttaaaaaaaaaaaaattaaaaaataaaataagggttaggtacggtggtttatttttgtaattttcgtattttgggaggttaaggtgggtggattatttaaggttaggagtttaagattagtttggttaatatggggaaattttatttttaataaaaattatagaaattagttgggtatggtggtacgtatttgtaattttagttatttaggaggttgaggtaggagaatttgtttaaatttaggaggtggaggttgtagtgagtcgagattgcgttattgtattttagtttgggtaagagagatttcgttttaaaataaaataaaataaaaaagtatatgttatatgattttatgtataaaaagtttaaaatttggtaaaattaatttatggtaagatagtggtttttattttttatagggagaggataattgggaagatgtaaggaggtatttatggtgttggtaatgttttgtattttgatttggatagtggttagataggtatatttaaaaatttattaagttgtataattaaatttcgtattttgttaaaggaaaaaaaatattattttttagagttatattgaaatttagaggtttttttagagaaaaaaatatataattaaaaaatttataaagtttttttatttgttgatttaaaggtttttaattatatttagatggggatgtatttgaggtaataataaagggttcgggttgaatgataaaaagttataaaaatgtgaattattttttaatagaatatttatttaatgggtagtagagtttataaagatagtacgtttatttttgagaattttatagttttcgataaattatttttgatttcgaagttttagtagttgtttatttgttttaaaaaaggtagaagatttaagagagataatttatgagaattttttattgttatattttatttttttgaagattttaatagttattattgataaaaaaaaaaaaataggtagttttaggaatatattttttcgaagtatttttatgtttgtgataaattattatattgtttaagaaaatttaaattcgttttaggttagtattattttattattaattaagaaaaagtaataaataaatttaatttaaaggttagaaaattattagattagttttttagagtttgttattatggtaatagtttttattatgtttaaatatgtaaatattatggaagtattattgatttttttaggtatttagatttttaaaaatattaaagataatgattgaagtaagggtaattagtgtaaatttttgttgtagaaagtatagatttatttatttatttgggagagtaattagtaatatttattaatatttaaaatgattttattttttgataaaggaatttattttatagaataaagatattttgaaagtatgtttgtaaagttgaaaaaaaaattaaaatagtttaaatattaaggggattaaattatataattgatatgtaatgaaattttatgtaattatttaaaagaataaggtaaattttttgtatattgatagtaaatatatttaagatttattaagtgaaaaaaagttaattttttttttttttttttttttgagatagggttttattttatcgtttaggttggagtgtagtggtgtaattatggttttttgtagtttcgattttttgggtttaaataatttttttattttagttttttgagtagttgagataatagttatgtattattatgtttagttaatttttttgtttgtttttggtaaagataaggtttttttatgttgtttagtaattttttcgtttttgtttgtttaagggtagggattatagatatgagtttttatatttagtttatttttaattttatttggttagggtatggtggtttataattgtaattttagtatgttgtgaaattaaggtgggaggatcgtttgagtttaagagtttgagattagtttgggaaagatagggagattttgtttttataaaaaaaatgttttaattagttaggtgtggtagtatatatttatggttttagttattcgggaggttgagatgggaagattgtttgagtttaggaggtagaggttgtaggttgtagtgagttatagttatgttatcgtattttggtttgggagataaattaagatcgttttaaaaaaaaagtaaaatattttatttatatataatgatatatataattattttgttattttagttagaatttagaaaaaaatttgaagaaatagaaaattattaatagtggttattggagtaaagaatacggtgttgagttttgaggaaatatgagggaaaaaaagaaaaattatttatgaaggtggataaggtaataaattgatgttattattattgtgattatggtaattagattattttaatgaaaatatatgaattagagttttataaagttggaaaggattttagaggttataaatattaatattttatttgatgtatataatgtttaagaggtggtagggggtggttatgtttggggaggcgtattaattacgtgggaagttttttaaagtatatttattatttatagaatttggtaagttatttttagatggagaattattaattttttagagtttgtgttattgataaggatattatattttttagatgtattggaaataaaaaaggtaaaaaaaaaagtttgtttaaaatgttttattattaatgattttttagtttttttttgggtatttttaaagatggaaatttattatttttttaagtagtttgttttattttagtaattttgatttattttatttttttaaatgtttatttattttataaaatatttattaaatatttattatatgataagtattattttaggtgttaggaatatggtatagaataaaatagtttggtttttaaggaatttatatttttatggagagaaatatataattaataagttaataaataaattaggaattattaggtagagatatgtattatgaagaaaataaaataggataataaagagtgattgggaagttttttttaaatttaattataatagaaggtttttttaagagtttgttatttaagattaatatttgaaagataaggaattaattatgtaaaaatttgggggtagagtattttagatagtaagaataattttgatatgttataaatataaggatagacgttaggtatggtggtttatattcgtaattttagtattttgggaggtcgaggcgggtggataatttgaggtcgggagttcgagattagtttgattaatatggagaaatttcgtttttattaaaaatataaaataattagttaggtttggtggtgtatgtttgtaattttagttatttaggaggttgaggtagaagaatcgtttgaattcgggaggcggaagttgtagtaagtcgagatcgtgttattgtattttagtttgggtaataagagtaaaattttattttaaaaaaaaaaaaaaaaaaaaaaaaaaattaaggatagattaataagattatagtgattaaggggaaggatataagggttaaattttgaggggtatggtaagttttagaaaatagtatggatttagttataagagcggtggaatagtataatggttcgtaaggttaaaaagaggtagaaggtcgggcgtagtggtttacgtttgtaattttagtattttgggaggtcgaggtgggtggattataaggttaggaatttaagattagtttggttaagaaggtgaaattttatttttattaaaaataaaatataaaaaattagtcgggtgtagtggtaggtttttggaattttagttattagggaggttgaggtagaagaatcgtttgaattttaagggcggaggttgtagtgagttgagatcgcgttattgtattttagtttggcgatatagtgagattgcgttttaaaaaaataaaaataaaaataaaaataggttaggcgtagtggtttatatttgtaattttagtattttgggaagttaaggcgggcggattataaggttaggagatcgagattattttggttaatatggtgagatttatttttattaaaaaatataaaaaaaaaaaaaaaattagtcggttattgtggcgggtgtttgtagttttagttattcgggaggttgaggtaggagaatggcgtgaattcgggaggcggagtttgtagtgagtcgaaatcgcgttattgtattttagtttgggtaatagagcgagatttcgttttaaaaatataaaaaataaaaagaagtagaagaattatttaggatttaaagagtttaggggaatggtagtaaaaatggatagaaataaagatatataggttatattttggagaagatagagtttgttgatgaaatagatgtaggagataagagaaattaagggatttcggaaatttaaatttttttatttaaaaatataatcggtcgggtatggcggtttacgtttgtaattttagtattttgggaggtcgaggtgggtgaattatttgaggttaggagttcgtgattagtttggttaatatggcgaaatttcgtttttattaaaaatataaaaattagtcgggtatgggggagcgtgtttgtaattttagttatttaggaggttgaggtaggagaattgtttaaattcgggagatggaggttgtagtgagtcgagattgtgttattgtattttagtttgggtgatagagtgagattatgttttaaaaaaaaaaaaaaaaaaaattataattaatattgatattacgtattaattggtgaagaggtagatggttggatgagtaggtttgattttggatatgttaagtttaaggtatatattagatattaagtgaagatattaagttggtaattggatttattaatttggaattcgggggatagtttaaaattaaaaatataaaggagtagttgtaggtatataggtgttatttaagtttatttatttaaaaaaaaatataaagtgaaggtatttataattatgtttttagttagagaagcgtttagtataaaatagtagaaaggaaaaagtagtgaggtgagatagaataagtaggagagtgttgtatttaagaaaaaattttttttttatatagaagttaatatttatattaaatgttaaacgttgtaatatggtaagagtagttttagtgaagtaatttagtgaagtagcgaggatagattaatattaagagtgggttaaggaatgaatagttaagggaggaagtaggaatattaattatttttttaagaaattttgtaatgatggaaaggaaatgggatggtagttagaagattatttgtggttaaacggattttttttaaatagataatattagaatatgtttgtatgatgggaatgatttaggagagaaatagaaattaatgatacggaatagaggaataattgtagaagcggagtttttgagtgagtaagggaagattggattttttgtataagtagagtttttataggaaagagatatattatttattatgagaagttagagagtatgggtataaaagtaggtgatttgttatgatttagtggtgaaaagatgaaggaatttttatttattttttttttttagtgaaaaaataaaagtaagattattaattaagaataaaggaaaagaggaaaaatagagtgatttatgaagtttattttaggaaggcgaatgtataagagaaatattattgtaggattattaggtagggttggatgtatattgtgtttttatttttattaataattttttattagtattatatttatatttatttgtttgtattttttattaattataaattttgtgagagtagaagttacgtttgtgtgttttatagttgaatttttagtattttggtagagaatttagtatattattgtttattatttttgatatgattataggtttgtttattatttaatatatatagtgtttagtattgaggatggagagatgagaagatagtttttgtttttaagggtttattttttagagagaaggtagatatttaaatatagtataatgttatattttttttatatatatatatataaggtgaaaaaggaatatagaggaaagattttaatttgttggagagttagggaagggttttaaagggtaataagttaggtatagtgttgtgtgtttatagttttagttatttaggaggttgaggtaggattgtttgagttaaggagtttgaggttagtttgggtaatatagtaagattttgttttttttaaaaatagtaataaaaaaaaaaggaaattgtatttgagttgagaagtttaaaaagtgaaggaattttgaaggtagttaagtaaaggtaaatagtttgatatatgagagtgtttagagaatgataagtagtttaatattgttggagtagagtatagaggaggtagaggtaagagatgaagttgtagatagcgaggaagttagattatgaaagagtttgtatgttaaaaaaaaagttttaattttattttgggaaatataaattgtatatgggagtgatataattagatttgtaagttaaattaagtttgtaaatatagtagaagatggattggaaattagaggtcggaaggttagtaaggaggattatagtagtttttataagagatattgagaggttaaaatagaggatgaaaaagtagtaatgatatgaaagatatttagaaataagattattaggtatatgggtggtaaatttttaatttttcggataatagttatgagagataatattaggatttatagatttgatggataattttaaaagaaatgttggattttagtttataatagtttaatagttttcgtgagatagaaaattttggattaggtttttttgttttatagatttaaattggttttgaatttgtaaattaggaaaaataaaattattttttaagataaaattattttatatagattagagaatagaatagatgaaagttgggaaatgaattaaaatttgttttaagattaaagatttattttgaggatagttttaatgttttttatttattttttttaaatagtattttaaatgagtatagtttttagttgggtaaaaaaggaaattaaagggttgttaatattggaatataattttaaaaaagggatagatgtttttttttagagatatttaattataagataaatagttagttattggatgtttgaaatttgttttaaatagaaaaatattttatttttgaggtttttttaaagttaatatattatattttgatgatttaaaatatatataaaaaaagattttttaatgataattttttatttttggtttttttttgaaattatggttaagttttttagttatgagggaatagaagaaaatagattatttttatattattaggtttaataataataggttttttaaaggtttggtagcgttttgaattggtttaaaatgtattggttaatttttaaagagtatatgttaaattaatatatgtagagggaatagaagagaatagattgttaaaaaaaaatagagaagattaaagaatatttttttttaatttattttatatgttaatattaattttaaatttttttttttttttaaaaaagtatttttagtgtcgggtgtggtggtttacgtttgtaattttaatattttaggaggtcgaggcgggcgaattacgaggttaggagattaagattattttggttaatacgatgaaattttgtttttattaaaaatataaaaatttagttggacgtggtggtaggcgtttgtagttttagttatttaggaggttgaggtaggagaatggcgtgaacgtaggaggcggagtttgtagtgagtcgagatggcgtattttagtttgggggatagagcgagatttcgttttaaaaaaaaaaaaaaaagtatttttagaagttttattattatttataggataaagtttaaatttttggtcgggtatagtgatttatatttgtaattttagtattttgggaggtagaggtaggcggattatttgaggttaggagtttgagattagtttgattaatatggagaaatttcgtttttattaaaaatataaaattcgtcgggcgtggtggtatatgtttgtaattttagttatttcggaggttgaggtaggagaattgtttaaatttgggagatagaggttgtagtgaatcgagatcgttattgtattttagtttgagaaaaaagagtaaaattttattttaaaaaaagtttaaattttttggtttggtatttaaatatttagtatttagtattatttaattttttaatagtatcgtttatattttttttttttagtttattggatttttttatttttttgtaataggaaattttataggaaagttagaaattttagtattataaaaaggaataaggttatttttgttaataattaaaataaaggataagcgtttaaattttttattaaaattagtttttagttgatgatttaggttaataaatggtagaagaggtaggatttaggaaagttaatgttgttaaaagaagggtaaattatatttttttgtggtaattaagaattattatgaattttttttttttttgaagttgtttttatttttatagttttattatttgttatttaatagatttggaaattttaattttttttattggttttattattaatatgtttttttattaggtttttttttaatgataagttatttagtttttattggagaggagaaaggtagtttagtttgttaatttaattttagttataacgggtttaaaaataggttttggtataagtgaaagttatttgtttaaaaaaattttttggttttattatattgataatttataattttagtttatgtttattttttagtaaattatattttttaaagtatttatgaaaaattattttagattttagaggtttatgaaggtagggtgatttttatatggagaaggtattttttttaaaattagtttttagattttgttttgtttttatttttttagatttggaaataaaaatattaaataaaattaaattaaaagtttttattaaggtttttttttcgggttggttaataaaaatatatagtatcgtggtagagggcggtgggtgggtggtggagaatatttagagtaaaggggtagtgtatttggtcggatgatggttaatatattttgaaggtaaggacgttattatagataattaggttttggttatttaggataaaagttaaagatggtaattaaatatttaattaaaaggttaatttgtaattttagtatataagttattagatttttagatttgttttaaattttaagaaatatttttggtgtgttagaataatgtaaatgtataataagtattttataggtttgtaattttaagtatagtattattgttattagattttttttttttttttttgaggttgagttttatttttatttaagttgaagtgtaatggtacgatttcggtttattataatttttatttttcgggtttaagcgattttgttttagtttttcgagtagttgggattataggtgtgtgttattatgtttggttaatttatgtatttttagtagagatggggttttattatgttggttaggttggttttgaatttttgattttaagtgatttgtttatttcggttttttaaagtattgggattataggtatgagttattgtgttaggtttttagataattttaatgttgtattttgtttgtattttaattagattataaattttttacggataaagaatatgtgttaaagtttttattataatgttttatattggattgaaaatataattgatgatttgattgatgattatattgaaaagaaattatgaatgttggtatgtttttaaagttaaagtagtaggtgatattagtgatagaggttacgtttgtttttagtatttattgaattttcgttgggtaagaaaagttagattttaataaaaattgatggagattgttttcgttaaatatagtagtttataaggttattaaattttggaattaaaaggaaaaataaggttaaaatagagttatgtgaataaaaattgggtttaggatagtgaaataatagtttttttaataagaaaaaaagtagtagtagttaaaaggtaaaattaagtaaaggatgatttaataagaaaagtattagtatttatattttttgtatttttattgaaacgttttatcggagattggtaatgattaggttaagatgatagagatgatttaaggttgggttttttatttgaaaagtttattaattttagagttgtgttaaatttaagttaaagttggaatagggtttttttcggattaatattaagtgaagtggattattaagtggagtagcggtacgaaggtggtttttttagatttttaagtttaatttttacggagtcgtttggtattaggtatataatttaagttttttgagttttaatttttttatttataataaaagggtaatgtaggttttttttataattttaaggggcggtggtttgatatagagtattatgaaaataaaagtagtatattaaagtaatatattattattatgattatttatagaattattattcgttaggatgaaattttttatataagagatgaagttcgagagaaaagagttgaaggggaaggtttttacgaggagatagtaatcgaattgtagcgtttcggttagtagtatatatagtaggtacgcgtttagtaattttagacgttgcggagtggagtttaagtatttttttaagaatcgcgaaatgatagatattatcgacgtcgatataattgtacgtaaggtattttagttcgcgttttaaatttttggaggattcgtcgattatatcggatgtgttgtttgcgtatgcgtattttcgtgatttaatttcgtttttttcggtgtgttaatttgcgtaggcgttgaggtcggttagggcgcgtaataattaatgcgtagacgcggattgtattaatagatttaattataatttagaaaagttaatgcgtttgcgtaatggttttattaatgagttggggacgtgtattttttttgttttgttttcgttcgttagttcggtgacgtttatagttgttttggtaataagatatattgggaggaagaggggaataagttttattggggatcgcgtagttaattagaggtattcggttttttttggtttttttgagttttggaagatttaacggtttgtatttattttgaggtaatgtttggcgtttttggggtttgatattagtttgattttaattttgttaagggcgttgtttgtagatgtttgttatagattattggaataagttaagtttattcgtagtgagattcggcgcggttaattattgtataggttttagtttagatttaattatttgggggagtgagtgggtgtggtgaggggcgggaggtagggaggaagtttgattttagtagggttttgaattggaattcgggatttggttttgtaatgttaatatttattgggcgtttttttggggtttgacgttgtattaatttgtagggatttttacgtgaattagatatatttgtagttttaaaagagttggtgaagggagggatagttgtcgaatgtcgtgtaaaaagtatatggttaagtttagtagtttttttttcgtaagttggtattttgaatttggtgtaatatttcgggatgttagcgtcgaaaggttcgaaagagtatgtttggtttaattttattttttttaatttattttgtagaagaaattgaaatggttttaggttttgtattttaataagtgggattattttgagggttttaattgtttttttttttttttttttgagacggagttttgttttgtcggttaggttggagtgtagtgtcgcgatttcggtttattgtaattttcgtttttttagtagttgggattataggtacgcgttattacgttcggttaatttttgtatttttagtagagacggagttttattattgttagttaggttggtttcgaatttttgattttgtgattcgttagtttcggttttttaaagtgttgggattataggtatgagttattgtattcggtttgttttaattttttttaagaaattaagttttggttttcgttgtttttttaattttacgtgaattcgattttttagatttagtttattttattttttagttgtaagtttttttatatatgattaggtattttatttttagttttttaatattttgaattgtacgtgagtaaaatttttaaaatagtaggtgaataatagcgtttttgtttttttattttttttttttttttttttgagatgaagttttgtttttgttatttaggttggagtgtagtgaatggtgcgatttcggtttattgtaatttttattttttgggtttaagttatttttttgttttagtttttcgagtagttgggattagaggtatttgttattacgttcggttaatttttgtatttttagtagaaacggggtttcgttatgttggttaagttgattttgaatttttgattttaggtgatttgtttgttttagttttttaaagtgttgggattataggagtgagttattgcgtcggtttttttttattttttatttgtttttagattggaaattttatacgtattaattaacggatgtattattagtggtgattaaagttttatttaagttttagaaagaagagaaataatttaagaaatttttagagtttatttgaatagatagatttatatttatattcgtggagatttgtgtagttatatgaatataagtttagtttaaatttatgttgttgagaaagaaaaaaaaagagtggataataagttggtttttattttaatataatatggtaggaagtattaatttttttgataagttgaatttttttttttgttttattaataagtaggagggtagtttttttacgaatatttaattttaaattttataggttaggttgatgttttttaattatttaggtgtggattttttagggagtttttgttttattagttaggttttttttagtgtttttttttttatgttttgtttgtttttgatttatgttaattattattattaagatttttttaggaatttttataggagagaagaagagatgaaaaatattaaatggatttattgaatgtatttgtttttgagatttgttagttatattaatatattatattagggtttttttgaattatttaaaatagtaagaaaaggtttatttttttatttagtttatgattttataattattgaaatatttttaattgatttgttaataggaaattgttaatattagtgttgattttaattagtttaaattagaatattaatatagtttaaaatttttgtttagagtagtggataagagtgtaagttttagaattagatagttttaggtttgaattttgattttgttgtttattagttgtttaatttggaataagttatttagtttgatagttttattttttttttttataaaatagaaataataatatttggtttattgaaattatgtgaggattaaatgagataatgttaagtattaagttgttagtatagtgtttggtagatagtaaatgtttagtaaatgtttgtttttattaattattattaattttagtaattaattatgtttgttttttttagttttttgaatgattaaaagttagttaaattatagcgtttttaataatttgggtatgtaaaagatagtattggagggattgtaatttaaatggtttttaaagggtagatttaatttataagttgaaattgaagttagagtatattttaggggttttattatataaaataatggaagagtggaggagtaagagggtttttttaagggtaaagtttatgattttatattatatattttttataaaaagaaattatattatttattaaaagaaatataaattttttaaagtttgagtagataataatttttttaaaggaaattttcgtatggaaaagaatgttttttttatttttttttttttgtattgttacgtttgttttaagatttttttttttgtttttgttaattgttattgtatatataatttttattttttaaattttggttttagtgtgattaaaattttttttttttgttttttaatagaatagataaaataggttattatttttagaaataaaaatttaaggagaattaagttgtaaatagtataaagttaaatttttaaagtattaagtttttgattaagttttagtaaagtagtaaatatttttagtgaatttatatttttttatttttttagtttttgatgaagtggaataattttttagtttttttgtttggttttttttttttttagttgtttgggagttttaaaaaagttttagttttgtttttttgttggtattcgaaagtgagtttattatattgttttttttaagagtagattatttattataatatggggttgaaattattagtgtttgagtaatagtgtgtaatagaattttttgtgataatgtttttgtattgtttagtatagtaattgttagatatatgtggttattgagtatttaaattagttagtgttgtaatttaaatgtaggtttattttttcgttgtttgtagagtttatttaataagagtgagatttggtataaagaaaatgatattttattttaaagttattttaggggaggaagtattggttttttgttttaagggtattattttatttttggagtagaaagagggtgtttttgaaatggggtatggaatgttggtatgaatggtacgaggggaggaagcgagtggttggggggtttgtatattatttttagtgttttatttattggatagtgattgttggtgttttttgtgggtaggattgggttgtaaaagtggttaaaattttttaggtaagagaaagttttgtagtaggtatattttgggttgtagataggttgttgttttttaaggtaatttttcggtgggtgagagtttttttttggagtttttaagtatatagttagatgaatttgttttatagggagtgtttgataaagaggaggtaaaaggttataattgtatttttaaagagttaaggaggaagtgaggagaagggggaaaagaagagagattttttaaaaattattaaattattttttagaaaaatggggatatttggttatagtgtgattaaggaaattttatttggtttttatttaaatttaagtagttatttgtggttagtggttgttattggatagaataatttatgagttattttatttatttttatgtttagttaaagagatatattttgtttatagtttatttaaatggtagtgatatttatttgaaataagaataatttatagttgttaggtttgagttattagtttattagttttatttatttttggaatatttagtgatgatttatagttatagaaagagggtttgtaattttttaaggagtttattttgttcgttgtttagatagagttggtttattaagattgggtaattagaatggagaaagagtaatttatatatagttagttgtgtaggagaacggaattttattattatttaaattagtttttttaagtattcggggattagagtttttaaggataatttggttggggaagttagtgagttacgagttttgatggtcggggatgaaattataaggagttaaagttgtttttttgttttgagtttttgggtggggggcgttgtaagattagatgagttagtttattaatttgagtggtattagttgatttattaagtgtaggggttattaaatat

SEQ ID NO: 19 - DNA, 6274 bp, Artificial Sequence
  Chemically treated genomic DNA (Homo sapiens)
ggattatttgagtttgggaagttgaggttgtagtgagttaaggttacgttattgtattttggattgggtaatagagttagattttgttttaaaaaaaagaaaaattttatggttttgtttatattatttatttgattttatatgttgtttattttttttattaaaatttttagtttattaattatagtttttttataattaatatttcgatgtgataatgttttagtttaattattgtggttataatagaatgttataaattgggtgatttataaataaaagaagttgatttaggttgatttagaggttggggagtttaagagtttggtgttagtatttgatgagtgtttttttgttttattataatatgggagagggtattacgtgtgaagagagtttatttttataatatagttatttttataagaattaatttatcgttatgagagttatgtgaatttatttatgaggatagcgggttaagtttttaatatatggatttttcggggatatatttaaattatagtagttagttgtaacgttcgtgttatgttttattttggttttgatgtttgtgtagtttttttaaattgcgtttttgttttttagtgtgttttgtaatgtggaaatgatatattgggtaagaggagttgtagtaaagaggtttttagtgacgtagtgataagttgtggggagagggagtgttgtatagttttgtcgtatgttatagttttttagtgagtttgtgtttttggattgtgaattttatgtttgttttttagtttttttagttttttagatggtatagaattgttggaggggggtggagttgtatattttttttgttttgggtaggttattttttgataaaatattaggttaggtttttggtgaaataattttttttgagggtagattttttattaataatagaatgttttaatttattttaaaatggttttttttttttttttattgttagaagtataatgagattttttttttaatattcgtggtaaggatttagtagagttttaggaggtaatatttttaagtgttttatattattttgtattatgattgggttttgttggagtttttaatttgtagaattgtttatattgagtttttcgtaattttttaattatagggtaaatttttttagtcggtattgggtttttggaggtttttgtttgttggtttttttttttggaggttgtgtttttgtgtttgtttgtttttttaatttggggggtagtggtttgtttaatgattttaattttttgaaagagttaagaagaggtgttaatttttcggtttgtttagttttttatttgttgttagaatggagcgttaatagtgttttttatagtgatatgtaatttttaattttagagatgatgaagtatattaatgataaaggagaaatgttttagtagttttttgttagtatattattttttgaaaaagttgttttttttatattttgtaagagatgggttttaatttagagtttaaggtaaatgattttttttaaggagaaggaataaatagttttagaaattatgaaagtttgtttttaggagtgtttttgaattttagtaggggttatatttattttgtagaaataggtgaggtatgtttttggtataaaattttaatggtatagaaggataaattgaaaaataagtttttttttaaatttttgatttcgagttatttagtttttttttttagaggtaaagttgttattagatttttgtatttttttaatatatatttttagaagagttgttaagtgaatatatgtttaagtgaaaatttattttagaagtgtatttttttaaggaattttagggttggaaggaatttgtgttagtttttaatttataatttttattagtatttattgtttttgtataaaaattttttttaaaaaagttttttttattttgatatagtttattttatttttatttagttttaataatttataaaatatatttttgaaagtttaaaatttgttattatgttttttttttttaattaatttttattttgatttttaagttagagaaaataggtggttaaatgttttttgtttaagatggaatttagaatatttgaagattttagatttttattttgttaaataacgtgttttttttttttttttatagagtatttggttttaggaaatttagagttatattttttatagataagattaaatttttatttaatatatttagaaattttttttaagaggataattatttattagaggaaaaaagttttttatgtatagttggtaaagggatggaattatttgtgttattaaaattgatagacgtttatgagatttattaagggaaatattagagttttagtatatatttgttaatatagtatatatgaaggttttatttataatttttttggttaagtagaaattttggtattatttattttaataaatttttaagatattatgaaatagaattttaggttttgatattattatttgttttaggttttgaagcgttgttggataagaggggtaaaatacggttttgttttggatttaaagttggttttttatattagtaagtatattttggtattttggttatttttttcggttatagtattatattgttataaaaggtagatataagtattaattagtttataggttattagataagtttagtttgattaatgtttaatatagtaattgggttattattgttatttttgtggtggtggtatatatatttagtttttgttcgggttatggtttaggattattttttatagaggttgtgagttagagttttaattgtgtagggttttaattatgttaggttatttattttttttaagaggattttattagtgtttgttcggttatatagttttttatttattaagtaatatagttattagtatattttaggtattagttaaggattataaaattaacgtgaatgttagtttttgtattaaaagtttaaaggagaaatttaaattttatatagatgttttatgaagatgtttagtaaatttatttttttttgttttttggaatttattttagtattgtgttatgtgtgtgtttagtaattttttataaaaagttttgttttttgtgatgttattagattatattgaagaatatataagtcgtattatgaaggttgttgttttatatagttttaacgtagtgagaattgatgtttttatatgttgtttttttgggtatttaaagaaatttttgtatagttttataaattagttgtagtttaaattgatttgtgttgtgatttgtatatataggttatatttttttgatagaaaatatagtttaaaattaaatttgtagtttttgttaagtgaatgtataggattttattgtatttaggttttttattgtaagatttatttttgtttttattttatgttttattgttgtgttttttatttgtttttttttagttttgttttttgtgtttttacggattgtttttagtttaggtgtgtaggaagtatatatatgtttgtagagtttttatggtttttgtatttagggtatgattttaacgtatagtggttgtattgatttgttaaaataaaggaatagattattttttttaatttatagggaagttttaggttgtgcgggtagtgagtagatttgtgtttgtttgcgtttgttttggtgaaaaattttatcgtttaggttgtagggtgcgagatttaggtataaatattttgttggatgaggaggaaagatgtaaggttgtttttttttagagatagtaaagggtaggtttgtagttttatttattttaggattgtgatttttgatagagtcgagagattagggttgttgaattaggtttgaaggttttagtgaatttcgtgaagagaggaggggtttggttgtaatatggatttagaggatatttttattgtaggagaaggaatagtggggatggggtggatttgttaaaggaatatagtttaagtttttgtagtttaaaaaagtttagttttttttggttaaagttttcgcgagtttttttggtattttttttgcgggagttataggggtagtgggatatttagtttttttaaaagtatttttacggttgtttgtgttaagtttttattttaagagttttatttttgcgaagtaatgtgttttatatattggttttaaagtatttatggttggttgtaataaatattaaggaggtttgtttttgtattcggagttgggtgtttttattttagatgatttcgagggtgtttgataagatttgaaggattttcggattttagagtattatttcggacgtttggtatttttgtcgcgcgggtacggcgatttttttagttgttaggttagtttttgattttcgagagggtttcgtagtgttgtaggggaggtggggattcgaataaaggagtagttttttcgtcggtgttattattcgacgttggttttaaggttcggttagtttgtttaaagttggtataagtttgttttgtaaaataaaagaagggaaagggggaaggggattttggtatagatttggttcgatttggatataggttgggtttgtaagttcgcggggatcgggtttagaggggtagtgttgggaacgtttttttcggaaattaattttttagggtattcgttttttttttatgcgtcgttttattttcgtcggagattaggtttcgcgggggttatcgttgtttatcgttttcggcggtcgttggttttgggttttcgttgttggtttttttttttttttttcgtatttttttttttttttgtttttttcgatttttttttcgtcgtttggtttttttttttttcgttttgttttttcgcgtttcggttcgcgcgagttagacgttcgggtagttttcggcgtagcgcggtcgtagtagttttcgtttttcgtacggtgtgagcgttcgacgcggtcgaggcggtcggagtttcgagttagtttcggcggtcgtcgtcgtttagatcggacgataggttatttcgtcggcgttcgttcgagttttcgtttcgtcgttaacgttataattatcgcgtacggttttttgatttcgtttagtattgatcgggagagtcggagcgagtttttcggggagtagcgatgcgatttttcgggacggtcggggtagcgtttttggcgttgttggttgcgttttgttcggcgagtcgggttttggaggaaaagaaaggtaagggcgtgtttcgtcggttttcgcgtcgttttcggatcgcgtttcggatttcgtagttcgtttaatcgcgtatcggcgtatcggttcggcgttcgcgttttcgttcgtttttttttgtttttttgagattagttgcgtcgtcgatcgggatcgcgggaggaacgggacgtttcgtttttcggtcgggagagtttggggcgggcggaggaggagacgcgtgggatatcgggttgtaggttaggcggggaacggtcgtcgggattttcggcgtttcgaatcgtttttaattttttttttttatttttttcgtttagttgcgtaggatcggcgttagtgggcgaaagtcgggtgttggtgggcgtttggggtcggggtttcgtacgtgcgtttcgcgttgtttttttagggcgcgacggggttttggcgcgtattcgaggggcgggcgttgtttattcgtcgagattgtattgtttagggaagttgaggaaggaatttaaaaatatagttttttttcggatttcgcgggataggcggttttttgagaggattttttcgttttcgtttttcgcgtaggttttaaattgaagtcggcgttcgttagtttggtttcggtttttttttaggttttcgcgattttcgttttttagtgtggagtcgtagtttcgatttgggagttgggagaattcgtttattattatttgcggttttcggggaggggtggtgttggcggcggttagttttttcgttggtaaaaggtaggtggggttcgattcgttttttgggcgtagatttcggtcgttcgtttcgttcggtgcgttttcgttttgtttatttaagagtgttttttatttttcggggattttagtttttttttgggcgttcgcgtcgaaagttttaggttttttttcgatggtcgtttcgcggagacgttcgggtttgttttatttgtagtttttcggtcgcgtttgggtttcgcggtggagcgggacgcggttgt

SEQ ID NO: 20 - DNA, 6274 bp, Artificial Sequence
  Chemically treated genomic DNA (Homo sapiens)
atagtcgcgtttcgttttatcgcgaagtttaggcgcgatcgaagggttgtaggtggagtagattcggacgttttcgcgaggcggttatcgaaggagagtttggggttttcggcgcgggcgtttaggagggagttggggttttcgggaggtggggggtatttttggataggtaagacgagggcgtatcgggcgaggcgagcggtcggggtttgcgtttaaggggcgggtcggattttatttgttttttgttaacgaggaaattaatcgtcgttagtattattttttttcgggagtcgtaggtggtggtagacgagtttttttagtttttaggtcgaggttgcgattttatattggggaacgaggatcgcggggatttggagaggggtcggggttaggttggcgggcgtcggttttagtttgagatttgcgcggagggcggaggcggggaggtttttttagaaagtcgtttgtttcgcggggttcgaggggaggttgtatttttgggttttttttttagtttttttaaatagtgtagtttcggcgggtgggtagcgttcgtttttcgggtgcgcgttaggatttcgtcgcgttttgggaagatagcgcggggcgtacgtgcgggatttcggttttaggcgtttattagtattcggttttcgtttattgacgtcgattttgcgtagttgggcggggaaagtgagggaagaaagttgggagcggttcggggcgtcggaggtttcggcggtcgtttttcgtttggtttgtagttcggtgttttacgcgttttttttttcgttcgttttagattttttcggtcgaagaacgaaacgtttcgtttttttcgcggtttcggtcggcggcgtagttgattttaaggaaataggaaaggacgggcgggggcgcgggcgtcgagtcggtgcgtcggtgcgcggttgggcgggttgcggggttcggggcgcgattcgggggcggcgcgggagtcggcgagatacgtttttatttttttttttttttagagttcgattcgtcgggtagagcgtagttagtagcgttaggagcgttgtttcggtcgtttcggagggtcgtatcgttgtttttcgaagagttcgtttcggttttttcgattaatattggacggagttagggggtcgtgcgcggtggttgtggcgttggcggcgaggcggggattcgggcggacgtcgacgaggtggtttgtcgttcggtttgggcggcggcggtcgtcggggttagttcgggatttcggtcgtttcggtcgcgtcgggcgtttatatcgtgcggggggcggaggttgttgcggtcgcgttgcgtcgggggttgttcggacgtttagttcgcgcgggtcgaggcgcggggaggtagggcgggaggaggagggattaggcggcggaggagggatcgggaggagtagaggaggaggagaatgcgaggaggagggaggagaattagtagcggggatttaaggttagcggtcgtcggaggcggtggatagcggtggttttcgcgggatttagttttcggcgggagtggggcggcgtatgggaggggagcgggtgttttgaggagttaattttcgagaggggcgtttttagtattgtttttttggattcggttttcgcggatttgtaggtttagtttatgtttaggtcgagttaaatttgtgttagggtttttttttttttttttttttttttgttttataaagtaaatttgtattagttttagatagattggtcgagttttagagttagcgtcggataatggtatcgacggggaaattgtttttttattcgggtttttattttttttgtagtattacgggattttttcggggattagaggttggtttggtagttgaggaggtcgtcgtgttcgcgcggtaggggtgttaggcgttcgaggtggtgttttaaagttcgagggttttttagattttgttaagtattttcgaaattatttgaaatgagggtatttaatttcgggtgtagagataggtttttttaatgtttattgtaattagttatgggtattttgaagttaatgtgtgaagtatattatttcgtaaaagtgaagtttttggaataaaggtttgatataaatagtcgtggaggtgtttttagagaggttaagtgttttattgtttttgtagttttcgtaggagaaatgttagggaaattcgcggaagttttggttaaaagaaattgagtttttttgggttgtaggaatttgagttatatttttttggtaagtttattttatttttattgtttttttttttgtagtaaaaatgttttttaggtttatgttatagttagattttttttttttttacgagatttattaggatttttaggtttggtttaataattttgatttttcggttttgttaaaaattataattttgaagtaagtgaagttatagatttgttttttgttgtttttgaaggggagtaattttatattttttttttttatttagtaaaatgtttgtgtttgggtttcgtattttgtagtttgaacggtggggttttttattagggtaagcgtagatagatataggtttgtttattgttcgtataatttggaatttttttgtgaattaggagaagtaatttgtttttttgttttaataaattagtatagttattgtgcgttgaagttatgttttgaatgtagaggttatgaaggttttgtaggtatgtgtgtgttttttgtatatttgggttgagagtagttcgtagaaatatagaaaataaaattagagaaaggtaaatgggaagtataatagtggaatataaaatgaagataggagtgagttttataataaaagatttgaatataataaagttttgtgtatttatttaataagggttgtaaatttggttttaaattatattttttgttaagggaatgtgatttgtgtgtataagttataatataaattaatttaagttataattgatttgtaagattgtataggaatttttttgagtgtttaaaaagatagtatgtaagaatattagtttttattacgttaggattatatgagataatagtttttatagtacggtttgtatattttttaatgtgatttgatagtattataagaaatagagttttttgtaaagaattattagatatatatatagtataatattgggatggattttagggaatagagaagaatgggtttgttgaatatttttatgggatatttatgtaaagtttgagttttttttttgagtttttgatataaaagttgatatttacgttgattttgtagtttttggttagtatttggagtgtgttgataattgtgttatttggtaagtaaaaaattgtatggtcgagtaggtattaatgaagtttttttaagagagataagtagtttggtatagttagggttttgtatagttagggttttagtttatagtttttgtggagggtggttttagattatggttcggatagaggttgggtgtgtgtgttattattataggaatgataatagtggtttagttgttgtgttaagtattggttagattaagtttatttgataatttgtgagttggttaatatttgtatttgttttttatagtaatgtgatgttgtggtcgggagaagtgattaggatattaaggtatatttgttagtatgagaggttaattttgaatttaaggtagagtcgtgttttattttttttgtttagtaacgttttaaaatttgagataaatggtgatgttaggatttaaaattttattttataatgttttggaaatttgttagggtgagtaatattaaaatttttgtttggttaaaaaaattatagataaagtttttatgtatgttatattagtaagtatgtattaagattttagtattttttttaataaattttataagcgtttgttaattttaataatatagatggttttatttttttgttagttgtatatgagaaattttttttttttgatgagtggttatttttttagaagaagtttttgagtatgttgaataagagtttagttttgtttataaggaatgtggttttgaattttttaaaattaaatgttttgtgaaaggggaggagaaatacgttatttggtagggtgaagatttgaggtttttaaatattttaagttttattttaggtaaaaggtatttgattatttgttttttttggtttagaggttaaagtaaagattgattaggaaaaaaaaatatagtggtagattttagatttttaaaaatatgttttataagttattggagttaagtaaaagtagaataagttatgttagagtggaaagggtttttttgagaaagatttttgtgtaagaataataagtattaatggaggttgtgaattaaggattgatataggttttttttaattttaaagttttttaagaaaatgtatttttaaaataggtttttatttaaatatgtgtttatttgatagtttttttaaggatatatgttaaggagatataagaatttggtaatagttttgtttttagggaggagaattaggtagttcggggttaggggtttagagggagatttgttttttaatttgtttttttgtattattgggattttgtattaggagtatgttttatttatttttgtaaggtaagtgtggtttttgttgaggtttagggatatttttgggggtaggtttttatggtttttgagattgtttattttttttttttgaaggaagttatttgttttgagttttgagttgagatttattttttgtagaatgtggaagaagtagtttttttaaggggtaatgtgttgatagaaaattgttgaagtattttttttttgttattagtatgttttattatttttagagttgagggttatatgttattataggaggtattattggcgttttattttagtaataagtagaaagttgagtaaatcgaaaaattaatatttttttttagtttttttagagaattgaggttattgggtaaattattgttttttaaattggagagataggtaaatatagaagtataatttttagaggaagaaattagtagatagaaatttttaaggatttagtgtcggttgggaaagtttgttttgtaattgagaaattgcgggaggtttagtgtgggtagttttgtaaattaagaattttagtagagtttagttatggtgtagggtagtatgagatatttgagagtgttattttttggagttttgttaggtttttattacgaatattagggggaaaattttattatgtttttggtagtggaaggagaagaggaattattttgaaataggttggaatattttattattaatagaaggtttgtttttaggagaaattattttattagaggtttaatttggtgttttattagagggtgatttatttagagtaagggaaatatataattttatttttttttaatagttttgtattatttaaggggttggggaagttgagaagtaagtatgaagtttatagtttagggatataggtttattggaagattgtgatatgcggtaggattgtgtaatattttttttttttatagtttgttattacgttattagaagtttttttattatagttttttttatttagtatattatttttatattgtaaggtatattaaaaggtaaagacgtagtttgaagagattgtataagtattagaattagaatgagatatgatacgaacgttataattaattgttgtggtttgaatgtgttttcgaaaagtttatatattggaaatttaattcgttgtttttatgaatgaatttatatggtttttatggcggtgggttaatttttgtgggagtggttatgttataagagtaagttttttttatacgtgatgtttttttttatgttatgatgaagtaagaagatatttattagatgttagtattaagtttttggattttttagtttttaaattagtttaaattagttttttttgtttataaattatttagtttgtggtattttgttataattatagtaattggattaagatattattatatcggagtattaattataaaaaaattatgattaataggttaggagttttaatggaaaaaataggtaatatgtaagattagatggataatgtaagtagagttatggaattttttttttttttgagatagggtttggttttgttgtttaatttagagtgtagtggcgtgattttggtttattgtaattttaattttttaggtttaggtgattt

SEQ ID NO: 21 - DNA, 5312 bp, Artificial Sequence
  Chemically treated genomic DNA (Homo sapiens)
gtcggtttcgggggtcgacgatttttcgggtaggcgacgtgttttgtttaggttttatttttcgcgttcgtaaaacggggtggataacgtagtttaaggtagagtcgcgttaaggtttttcgttgtcgtcgggttttggcggtttgatcgggtttggggttcgagcgtgttttcgggtttgggggggtcgtcgcgatggattcgttggtagcgttttaggatcgtttggtggagtagttgttgtcgtcgcggatttaggtttagaggcggtttaaggtgcgtgtgtggagagggcggaacgtgggtttgtgatttcgcgggtttcgggattcggtatggggttttcgttttcgcgcgttacggttcgttagcgtttaggtttagttttttttttcgtagcggtttcgtaggttcgcggttttacggtggggcgacgtgttttgtttaggttttattttacgcgattttaaaacgcggcggagaatgcggtcgtgggatttttttaggggttttaagggtttgcgggggttgggcgtttgggcgcgcgggcgggggaggttcggcgtcgcggtttataaataggcgttgtttcgttatcgtcgttgtcgtcgttttcgcggttggattcgggttaggtggggtttttcgttttttggtatttttcggaggggtgagtgtcgaggtttttagttttttcggtttatggagggttttgagtgtgttttaggggttttaattttgttgttttttgttcgaggagggaggatatcgtttgtgtttgttgcggtttgatatttttttacggaataaatatagtgtcggtttttgtagagttttttttgggattggggttaggggtgtttttttttgttattatttcgtttgtttttttatttttaggtttttgtttacgggttttttttttatttttgttaacgaaatgttttattttgggaatcgtattttttgttgtttttttatatcgtatttggtaagagatagggtattgggtttttggagaaatttttgtgtttttattttgttttattttgtttttaggatattgataagtagtacgtgggtttcgttatattgtttaattaggtgtatcgtaagtcggtgaagaaaggttttgattttatatttatggtggttggtgagtgggttaggtttttcgggggagtggttggggttattggttagttaagttttgtcgttggagttttagatttaacgtagttttttttttgtatttgtgtgtaggtgagttaggtttggggaagtttatattggtttatagtttttttttgatagatttgtataaggatcggaagttgtttagtgttgagggtgagtggtttttaggaggttttggtattgatttttagtttttttttatgggatttttttaaggatttttttttaggtttagtttttattgttttgttttcgcggtgtgggttttttgggggtagggttaaggtattaagatggatgaggacgagggttttggttgttaagggtgaggggttgagggttggagaggtttttttagtggtttttttttcgtagagcgtattagttagacggtagagattttaaaatatacggtggatattgaggagaagggagttaagttgaagtttattatcgtggatacgtcgggattcggggacgttgttaataatatcgagtggtgagtgaggtttgttgagaaaggttttgtttaggcggttatagtattcgaggtttggttttattttttttttgtttatagttggaagtttattatcgattatgtggattagtagtttgagtagtattttcgtgatgagagcggttttaatcgaaagaatatttaagataatcgagtgtattgttgtttatattttattttttttttcgggtatgggtgtgtggttgttttggggttaggttcgggagtgtagtttttataatatggttttttggttgtgtttatgtttatttttggttgttttcggtaggttgcggttagtggatgtgggttttatgaaggtattgtatgagaaggttaatatcgtgttttttatcgttaaagttgattgttttgtttttagtgagattcggaagttgaaggagcgggtgagtttgtcgtcgtataggggtttggttagggttttggggttgagagtattagggggatttgtttggttttaaatttgatggtttttgttttattatagattcgggaggagattgataagtttgggatttatgtatattagttttttgagtgtgattcggacgaggatgaggattttaagtagtaggatcgggaattgaaggtgaatatgtagattggtggggtaggggggatggagttggtgaggggtagaattagagggttttgttttttttatattgagtttgttggaggagggttaggttagtttagttgggtgtaagagttatttgttttaggagtagaggatttgtattttttttatttagggttagaaggtaaaggttattatgtttttgtttggttggggtgggttatgtgggtttcgtgtggtgtttggtaggtatggagtatttgtttagatttagaggtgtagtagtgggttaggtttttaattttaattttttttttatgggttattagaggaaggggttgttttagtggtatattttggtttttagatttttgagttttagggttggtggttttgggtgtttcggtagttagagtgatgatggagattatgttaggggtaggtggttattagggtaggggtattagtatggggagatataggtttagttttggggagggaaggggtagttggagggggtggtttttgatgagggaggagatgaggagggagtatgtttggttgggtatagtttggaaaggttttggaatgtgagttatatgggttttggttttagttaggggtagagaggttagaaaggggtaacgttaggatttttttgaggagagatagttgatggtgatgttggaggggtgtttcgggagttatatgttcgttttttattagtaatcgtgtaattacgtttatcgggtgtgagttttttttttttttttttttaggagagcgcgtttttcgtcgttataggtagtaatacggtggtggaggttaaggggtagcgggttcggggtcgattgtatttttgggggatcgtggagggtgagtagagttttggggtattaggtttggtgggggaaggttgttttgggtcggcgttagtttattatttatttttatttcgtagtggagaattaggcgtattgcgatttcgtgaagttgcgtaatatgtttattcgtacgtatatgtacgattttaaggacgtgacgtgcgacgtgtattacgagaattatcgcgcgtattgtatttagtagatgattaggtgcgcgttttagtcgcgagttagatttcgtttttttggtttcgtttacgtttttataattgagggtcggttttgttagtttatttagatttgaattttgtattattttttaagtttttttttttttttagagtttggtttttttagaattaagtttagggttgtgagggtttcggagggtagggttttagtagtggcggggatgggttaggtatcgttagtttacgttgagtttttcggtggcgtcgtttcgtttattttttttttcgtttcgcgtagtaaattgatttaggatagtcgtatggagagttttatttcgattttgtcgttgtttatttcggacgtcgagattgagaagtttattaggatgaaggatgaggaagtatgtggggcggcgggggcggcggaggcgggcgttagggatgttttttcgcggtgttgtttattcgtcgggttgttttcgttcgtagttgaggcgtatgtaggagatgttgtagaggatgaagtagtagatgtaggattagtgacgttcgtcgcggatatatcgttcgttttcgggacgttttcgtatttttggatattagatcggattgttttcgattcggagacgcggggttatagtttttagttgattttaatttatttttagtattatttttttttaggttattgtgtttgttttcgaggggtttggatcgtagttttcgtttagttggttttttttgattttgggggattaggagcgaagttgggcgggattttagagattcgttttttttgtttttttttcgttttcggacggttatagtatttaaatcgtaggttttgttttggtaggtaggtaaagttaggtagaagaggatttttaggattttgggtttgttttttgttttagtgttgtagaacggatttgggagtttttttttgtttgttttcgcgggttatttagcgagtgttgagattttattttttgtcgaggcgggtcgagtttttttttatttttagacgtttagcgggtagggttgggttgaattaaatgggagttttttagatataaggaggttagaggttgtaaggagcggggtcgtgatcgtttatattttttttttatagttcggttcgatttggagggttttcggggtattgggcggtgagttattttttggtaattttcggtgtcgttttttgttttcgttcgaggttttttttttttagtatcgttgtggtgtgtcgggattttgagtttaggtttttcgatgtttttattcgtatgattttttttcgttatacgatgtttcgttttttttcgttgtgaatgtcgcgttttgttttggtgataggagaataatgttggtgaacgtcgtagcgggtgttcgagtgtttcgtgtgtttttgagagcgggtgggagcggaagtttgagcggtttgcggttttcggcgatagtgtgttatttgtcgttgtagcgcgcgttcgcgcggtttttgggttatttttggttaggtcgtagtattgtggtcggtgcgggcgtggtaggggcggggcggttttatcgttcggttttttcgtttacgtttttcgttgtagagtaagtcgggttgtcgttttttcgttatgggtttcggtgagtttggagttcggtcgggttttcggttgttttttaggtcgattcgggttgagaggagttttggtcgtttggttgtagttgggagagatttgggttagatttagaggggatttttagtcggcgtgcggggtggttagggtggagaggttggcgggttatcgggacgtcgggtattaggggttggatggagtcgggtcggtagtttgggtatttagagatgtcgtttaggtgttcgtcgatcgttcggtttattgcggcgttttttttgtagg

SEQ ID NO: 22 - DNA, 5312 bp, Artificial Sequence
  Chemically treated genomic DNA (Homo sapiens)
tttgtaagggaagcgtcgtagtaagtcgagcggtcggcgggtatttgggcgatatttttgagtatttagattgtcggttcggttttatttagtttttgatgttcggcgtttcggtagttcgttagtttttttattttgattatttcgtacgtcggttggaagttttttttaagtttgatttaagttttttttagttgtagttaaacgattagagttttttttaattcgggtcggtttagggagtagtcgggggttcgatcggattttagatttatcggagtttatggcgagaagacggtagttcggtttattttgtagcgggaggcgtaggcgggagagtcgagcgataaggtcgtttcgtttttgttacgttcgtatcgattatagtgttgcggtttggttagaaatagtttagaggtcgcgcggacgcgcgttgtagcggtagatagtatattatcgtcggaggtcgtaggtcgtttaggttttcgtttttattcgtttttaggggtatacggagtattcggatattcgttgcgacgtttattaatattgtttttttgttattaggataggacgcggtatttataacggaagaaaacggagtatcgtgtggcgggaagggattatgcgggtgggaatatcgggaggtttaggtttaggatttcggtatattatagcggtgttggggagaagaggtttcgagcgagggtaggggacggtatcgagagttgttaggaggtggtttatcgtttagtgtttcgggggttttttaggtcgggtcgggttgtggagaaggggtgtaagcggttacgatttcgttttttgtagtttttggtttttttatgtttggagggtttttatttgatttagtttaattttgttcgttaggcgtttggggataagggaagattcggttcgtttcgatagaaaatggggttttagtattcgttgggtgattcgcgggagtaggtaaaggagggtttttaagttcgttttgtagtattggggtagggaatagatttaggattttgggaatttttttttgtttagttttgtttgtttgttagagtagggtttgcggtttgggtgttgtgatcgttcgggggcgggggaagggtaagggaggcggatttttgaagtttcgtttaatttcgtttttgattttttaaggttagagagggttagttgggcgggggttacggtttaggtttttcggaaatagatataatgatttgggagggggtggtgttgagaataaattagggttagttgggggttgtggtttcgcgttttcgggtcgggaatagttcggtttggtgtttaggggtgcgagggcgtttcggagacggacggtgtgttcgcggcgagcgttattggttttgtatttgttgttttattttttgtagtattttttgtatgcgttttagttgcgggcggagataattcggcgggtgagtagtatcgcggaggagtatttttgacgttcgttttcgtcgttttcgtcgttttatatatttttttattttttattttgataagttttttagtttcggcgttcggggtgggtagcggtaggatcgggatggggttttttatgcggttgttttgggttagtttgttgcgcggggcgggggggaggatgggcggggcggcgttatcgggaggtttagcgtgggttggcgatgtttggtttattttcgttattgttgaggttttgtttttcggagtttttatagttttggatttggttttagggagattaggttttgggggagggggggggtttagggaatggtgtaaagtttaagtttgggtgggttgataggatcggtttttagttatggagacgtgggcggggttagaggggcgaggtttggttcgcggttggggcgcgtatttggttatttgttggatgtagtgcgcgcggtagttttcgtagtgtacgtcgtacgttacgtttttgaggtcgtgtatatgcgtgcggatgagtatgttgcgtagttttacgaagtcgtaatgcgtttggttttttattgcggggtgggggtgggtagtgggttggcgtcggtttaggatagtttttttttattagatttggtattttaagattttatttattttttacgattttttaggggtatagtcggtttcggattcgttgttttttggtttttattatcgtgttgttgtttataacggcgaagggcgcgtttttttgggggaaggagggagaaaggtttatattcggtgagcgtaattgtacggttattgatgggaaacgggtatgtaattttcggggtatttttttagtattattattaattatttttttttaaagagattttggcgttgtttttttttggtttttttgtttttggttggagttagagtttatgtggtttatattttagggtttttttaggttatgtttaattaggtatgttttttttttatttttttttttattaagaattattttttttagttgttttttttttttttagggttgagtttatgtttttttatgttgatgtttttgttttggtggttatttgtttttggtatggtttttattattattttagttgtcggggtatttaaagttattaattttggagtttagaaatttgggagttagggtgtgttattggggtagtttttttttttggtgatttatgggaagagggttggggttgggggtttggtttattgttgtatttttggatttgggtaagtgttttatatttgttaagtattatacggggtttatatgatttattttagttaggtaaagatatggtgatttttattttttagttttggatgaagggggtataggttttttatttttagaataaatgatttttgtatttaattgggttgatttggtttttttttagtaggtttaatgtgaaggagataaagttttttggttttgttttttattagttttattttttttgttttattagtttgtatgtttatttttagttttcggttttgttgtttgaagtttttattttcgttcgagttatatttagggaattggtatatatggattttaaatttgttaattttttttcggatttgtggtggggtaaggattattagatttgaggttagataagtttttttggtatttttagttttagggttttggttaggtttttgtgcgacggtaggtttattcgtttttttagttttcggattttattggggataagatagttagttttggcgatgagaggtacgatgttgatttttttatgtaatgtttttatgaaatttatatttattggtcgtagtttgtcgagagtagttaagggtgggtataggtatagttagggggttatattgtaggggttgtattttcgagtttggttttaggatagttatatatttatgttcgaagggggagatgaagtataggtagtagtgtattcggttgttttggatgttttttcggttgaggtcgtttttattacggaagtattgtttaaattgttggtttatatagtcggtgatgggtttttagttgtgggtaggagggaggtgaggttaggtttcgagtgttgtggtcgtttaggtaaggttttttttagtaggttttatttattattcggtgttgttgatagcgttttcgaatttcggcgtgtttacgatggtgagttttagtttgatttttttttttttaatgtttatcgtgtgttttagaatttttatcgtttggttgatgcgttttacggggaaggggttattggaagggtttttttaatttttagttttttatttttggtagttaggattttcgtttttatttattttggtgttttggttttatttttaggggatttatatcgcgagaatagaatagtgggagttggatttgaaagggagtttttggagaggttttatggaaggggattggggattagtgttagggttttttgggggttatttatttttagtattgagtagttttcggtttttgtataagtttgttaggaagaggttgtggattagtgtggatttttttaggtttgatttatttgtatataggtatagagaaggagttgcgttaggtttggggttttaacgatagagtttggttggttagtgattttagttattttttcgaggagtttggtttatttattagttattatgagtgtgaagttaaagtttttttttatcgatttgcggtgtatttggttgggtagtgtggcgaagtttacgtattgtttgttaatgttttggggataggatggaatagggtagggatataaaggtttttttagaagtttaatattttgttttttattaaatgcggtatgaggagatagtagagggtacggtttttagggtggggtatttcgttggtaaaaataaggggagggttcgtgggtaaaagtttggagataagaaggtaggcgaggtggtggtaggagaaggtatttttggttttaattttagggagggttttgtagggatcgatattgtatttatttcgtggggagatgttaggtcgtagtaggtataggcgatgtttttttttttcgggtagagggtagtaggattgggatttttgggatatatttaaggttttttataagtcggagaagttgggggtttcgatatttattttttcggagagtgttagggggcgggaggttttatttggttcggatttagtcgcgggggcggcggtagcggcggtggcggagtagcgtttatttatagatcgcggcgtcgagtttttttcgttcgcgcgtttaggcgtttagttttcgtagatttttggggtttttggaggggttttacggtcgtatttttcgtcgcgttttggagtcgcgtgaggtgaggtttggatagggtacgtcgttttatcgtggggtcgcggatttgcgaggtcgttgcggagggaagggttgagtttaggcgttggcgggtcgtggcgcgcggggacggggattttatgtcgagtttcggagttcgcggggttatagatttacgtttcgttttttttatatacgtattttgagtcgtttttgggtttgggttcgcggcgatagtagttgttttattaggcggttttggggcgttgttagcgagtttatcgcggcgatttttttaggttcgggggtacgttcggattttaggttcggttaggtcgttagagttcggcgatagcgagggattttggcgcggttttgttttaggttgcgttgtttatttcgttttgcggacgcgggaagtgaggtttggatagggtacgtcgtttattcgggggatcgtcgattttcgaggtcgat

SEQ ID NO: 23 - DNA, 6352 bp, Artificial Sequence
  Chemically treated genomic DNA (Homo sapiens)
agggtattttatatttagagttttttttggtttaatagttataggtggtttgtggttattgtataggatagtatagtttttgaggaaggggattatgttttgtttttttgtgtttttagagtagtatatagtgtttaagttatattaggtgttttataaatatgtatttaatgaagaatattttttaatatttatttgaatttgttatgttttaaagaatatgatagatataattttattttaaagttagtattttagataatttagaataattggatttgtgttatttttaaaggatattttagtaagtttttgtcgaatttgtgtttgttttattattagattttagttttaataatagtatttttttttagagttagggttatttattttatttatttttatttgttattattgatttatttatttaataacgtgttagcgtttagggggaaaaggaagattgtgtaataaagatttaattatttatgatttttttttataggttttttttatttaggagggaatgtggattatatatatatattttaagaaaataaataatgaggaagttttggtgagattgaaaggtgttttgaattgggttgtttgttggttgtggttatgagaaggtttttggaattttttgtttttgttttttcggtgttggttttgagtaattattgtttgttttttgttgtaaaaaacgatggtaagattttgattgtttgtttagttgttgaggggtgggtgagaaaatttaagttgaaattttgttggagtgggaggagttggggattgttttagttattgttttttttgttattttagttattagtgttttttacgttttttagtgtttttattttgaagttttgatttgaagtgatatttaaagggtagtgattatggttttgcgttggtttaggattttagttggtttttttttttttttatatatatgatattaatatagatggttattagtgggttaaaataatatttttagggagtgtcgatattttaaaagaaaaatagtaaataggattatttatgtttttgaaagaagtggtagaaaatatagattagtcgtttaaaatgagtattaaaagtgtattttaaaagttagaagttattataatatgaaaaaatagagaatatagggaaaatatttagaagttttaggtgtaaaaaatatatataatagttaaagtaaaagttatattaatgggataaatagtgggagagatgtaattgaaaaataaaatagaaagatggaggattatattgaggagttagtttagaataaaagagggaagaattgagaagttattaatagaaaagttaggggaaaaggaggagagaattatttaaatatagattatatgagttttataaagataaaaaatagaggagaaaaatagttaaagaaataaaaagatgaatttttagaattaaaagatagagaagatttataatgttttatagagagaaggaaaaatttattttagatatattagtaaaatttaaaaatattaaagataatgagaaaattttagaagattttagtatgaaagattgatatgggattttttaattgtgatattggatgtaaaaaaaaaaatttggaatgatgttatttagaatattaaaggggaaaatattttaaatagtatgtaatatatagttaaattttatttaaaagtgttggtataattttaaaaaattattaagtatataagattttagaaggtttgttatgtaaatttttatatttgaaaggttttggaagaagaattttaattagagaacgtattttagaaggtgttaaaagatatgaaaagtaatgttgattaaataatttggtgaaggagaaaatatgtgaataaatttgaaagtatgttaaagtttttatttagttagagggaagatggagaaggtatcggtaatatttaaaaaaaaaaaaggtaatgaagattaaaaaagaaaatttggtcgggtgtgatggtttacgtttgtaattttagtagtttgtgaggtcgagttaggtagattgtttgagtttaggaggataagtttgggtaatacggtgaaatttcgtttttattaaaatataaaaaaaaaaaaaaaaaaatagttaagtatggtggtatgtatttggagttttagttattcgggaagttgaggagaatcgtttgaattcgggaagtagaggttgtagtgagttagtttagattatgttattatattttagtttggtaatagagcgagatttcgttttaaaaataaataaataaataaataaaaaaattttaaaaaatagaaatattgaaataaataaggtattataaataagtttaagtgtattaatatttataataaatataattagaatgtagtaaagatagggttatgtgtttattaaattattatatttttttgtatatataggtaacgtatatttttttattttcgtgcgtttatgtggggttattgtttattttttgttaatggaatgtgagtagagatggtaaatagtttttggtttaaaattatggaaataatgtgttttttttaggtttttttttttatttgtaaagttaggagtttatgaagtgttttttaataatagagatgtaaagtggagtttagttattttgaggtatgttttggaaaagagttatagagtgtttaatttgttttgaattatacgtggttaaaaaataaatttgtgttttgttaaattattgaggttttagtgtttgttttttgtagaaataagtttgtttattttgattattatatgaattgaatataggttagaagatagagatcgttagattgaattagaagtaaaaatttatatttatgatattttaagggttatatttaaagtataagtataaaggaagagtaaaaataaaagagtagaaaaagatatagtgaataaatatttaaagatagttgtagaatttattattattagataagatagagtaggatagaaagatttttaggataaattgggaaaaggtttagtttattaagattgtaataatttttaagagtaaatattttaataatttaaatgtagagagggtaaaagttgatttaaaaattagaaataagttgaaaaatttatagttatagttagagatttaaatatattatttataggttaggaattgtggggtatgtttatagttttagttattttgggaggttgaggtaggaggatcgtttaagtttagttgtttgaggttgtagcgagttatgattattttattgttttttagtttgagtaatagagtaaggttttgtttttaaaaaataaataaataaatgtattatttttagttatgtataggttagtttaaagataaagaaaatcgtaataaattagaatgataaaatttatatgtttgatttaataaatatgtatatgtataaaattttgtattatatttattagagtttatgtgaaatatttatagaagtttattatattttaagttatagaggattattatgtaattaaattataagttaataataaaaaatatattttaaaaaatttatgtatgtttttaaataaaaaaaaatattcgatattcgattgttattaattaaagaagtaatattttttattatgagttttttatggttttttcgttttttattttatggttttagtttttattttatttggggggaggtgaaggtggtaagggttttaattagggtaggattaaagtagtgaagatattgtttatttatgcgtaggtgttttttaggcgtttatgatgtgttaggtattacgtagatattgtggattagaaacgaaaaaattaagattagggttttttataaatcgggttatgtaaattaattattagttgttatttgattaatttgaagttagaagttgtgtttgttttatttaaaataggtattttttatttattgaggaaagagtattggagtaggttttattagtttatagattattcgagaattatttggggagtatgttgaaaatataggttttttggttttgttttggaaaggttaatttaatttattaagtaaagaggaaatttaggaatacgtattataacgaattttttaggtgatttttatttggaattagagattcgtatgattttttagttttttttaagttgaaaattatcgattttatggtttttgatatatggtttaatttggttagatttttttttatatagacgttagttttacgttgttgttgttttgttttgttttgttttttaaatatatatattggattaaatttttttagtgttttttattagtcgagtttaattagaagttaaaggtaagggtgatgtcgttttttagtttgtgttagtttggaggaggtgttcgggttttggagggattaatagagaggattagtatttttgtttttttcggggagtttacgggagttttttatattttgttttagattaaataattttaataattatatatttttttttatataatgaaattaaataataataaaagaaaaataaaataatatttttgaaagtgatttaaagttttaagaggtttttattttattgtgtagttaatgttttttttttaaagattattggtaaagtttattttattttttaatttaaaatttgtttacggaaattttttgggaaagtaggattttttgtatcgtagatggatatagagagaggatttgttggagtttagttgcgcggtgttttgacggttttttttttttttttagggggtttttttttggaggacgtggtaatagttggtttaagttttttttattttttaaaattttttttggttttttttgggggtttagtgaatttttttatttttttatttcggttttttttttttttatttagtaatagatatatttatttagagaatttttgtgattggttgaagatagaaggggtcgtttttattttcgaatttgttttttttttttttattttcgttttgtttttgtttttattatacggattgagattgatttgattaaagtattagagtgtaatggtttttagagtagggttggttttggggttttatattttgatgatttttttgagttcgtaggaggtaggggttattaagggtgagtgcgagggcgaggagggtgcggcggggagtagagatttacggagttgggttatatgaggaggtggtatggaggatgtttgtttttttcgttttttggtttatgggtaattttttttattaagagatatttaattttttttatttttgttatatttattttggatttaaatgaagatgtagttcggttagttgcgtaggtgttttagttagtttttgttgacgtttagatttttttttattttttttttttttttgagatttaaatttttatttaatagatgttagtaagtattttgatttttttattatttttggtttggaatgtgttcgattaagtttagttttgttgtagtatttatgtttatgtcggtagttaattatttatttgtttttgtttttcgggagatatgagttggggtgcgggtttatagatggtttatttttttttttttttatttttttggttttttattgtgttgggtgtatgttagttttttaataattgttgtttaaataattttatagagttttataagaattaaaatttaatttttaatttttagaaaattagataatagttatggaagagttatatttagttataatgttttgagatggaggaattgggatatgaattttgatttttgatttttcgtttagtgttttttgtaatgttttgagttgtttttttttatttttttggtttttgggttattaattttaatttttatttttgttagtcgtggtttgtttttttttatatttatttgtattgtatttttgtgtaaagttttatatttttttgtttttaattatttttttttattttatttttatagttttattagtttataatatagggtttgataatatagttagggtagatgattatagttaagatttaaattttggaattttaagtatgattttaggtagttttttttttttttattttgatatgttagattgtattgtttttgtgtcgattgtagtgtgttgggatgagtttttttttttttgtttttttttttttttttttttttagggttagtttagtgttagaataggattttgtttttatatagaatttaggacggggtttaggtttagggatttaataattatatattgtggatgagatagatatatttttttttttttttttgattttgaattcgttaaatatagt

SEQ ID NO: 24 - DNA, 6352 bp, Artificial Sequence
  Chemically treated genomic DNA (Homo sapiens)
gttgtgtttggcgagtttagggttaaggagagagaaaaaaatgtgtttgttttatttataatatgtgattgttgagtttttgagtttgggtttcgttttgggttttgtgtggggatagagttttgttttgatattgggttggttttgggagagagaaagggagagagaataggaagaaagaggtttattttagtatattgtagtcggtatagagatagtgtagtttggtatattaggatgggaagaggagggattgtttaaaattatgtttggggttttagaatttaaattttggttgtggttatttgttttggttgtgttgttaggttttgtgttgtgagttggtgggattgtgggggtgggatgaggaggaatgattaaggataggagagtatggagttttgtatagagatgtagtgtaggtgggtgtgaggggaaataggttacggttggtaggggtaagaattaaggttagtgatttagagattaaggggatagggagaggtaatttaaggtattataaagagtattggacgaggagttagaagttaaggtttatgttttaatttttttattttagagtattatgattgagtgtggtttttttataattgttgtttagttttttggaagttagggattaagttttaatttttgtagaattttatgaagttgtttgagtaatagttattgaggaattagtatgtatttagtataatggggggttagggaaataaaagaaaaaaaagatgaattatttgtagattcgtattttagtttatgtttttcgaagaataaagataggtaaatagttaattatcggtatgggtataaatattgtaatagaattggatttgatcgggtatattttaggttaggggtggtagagaaattagggtgtttgttggtatttgttgggtggaggtttgggttttaggaaggaggaaggaatgaggagaaatttgaacgttagtaaaggttgattggggtatttgcgtagttgatcgagttgtatttttatttaggtttagagtggatgtgatagagatgagggggattgggtgttttttggtgaaggaagttgtttataaattagagagcgagaggaataagtattttttatgttatttttttatgtaatttaatttcgtaaatttttgtttttcgtcgtatttttttcgttttcgtatttatttttggtggtttttgttttttgcgggtttaggagggttattagggtgtggaattttaggattagttttgttttgagggttattatattttggtgttttaattaaattagttttagttcgtgtggtgaggataggaataaggcggaggtaaagaagaagaaaatagattcgaggatgggggcgattttttttgtttttagttaattatagaaattttttgagtgaatgtatttgttgttgggtaaagagggaaagagtcggggtgagaaggtggaaggatttattgggtttttaggagaggttaaaggaagttttggaggatgggaggggtttggattaattattattacgttttttaagaagggattttttgaagagagagaaaaggtcgttagagtatcgcgtagttgagttttaataaattttttttttatgtttatttgcgatgtagggaattttatttttttaagaagttttcgtggataaattttgagttagaaagtaaaataaattttattaataatttttaaaaggaaaatattggttatataatggaataaaaattttttaaaattttaaattatttttaaaaatgttattttattttttttttattattatttaattttattgtgtaagaaaaaatgtgtaattgttggagttgtttggtttaaagtaaagtgtaaagagttttcgtggatttttcgaggagggtagaggtgttggttttttttgttggtttttttaggattcgggtattttttttaggttgatataggttggaggacggtattatttttgtttttggtttttggttgggttcggttaataagaggtattgggagaatttagtttagtatatatatttaaaaaataaaataaaataaaataataataacgtaaagttaacgtttgtgtaaagagaaatttaattaaattaggttatgtgttaaagattatgaaatcgatgatttttaatttggagggagttaggaaattatgcgggtttttggttttaaatgagaattatttggggggttcgttataatacgtgtttttgagttttttttttatttaatgggttagattagtttttttaaggtagggttagggaatttgtgtttttagtatgttttttaggtggttttcgggtagtttgtggattggtaaaatttgttttaatgttttttttttaatgaataagggatgtttattttaagtggggtagatatagtttttgattttaaattaattaaatgatagttagtaattgatttgtatggttcggtttatggggagttttaattttagttttttcgtttttagtttatagtgtttacgtaatgtttagtatattataggcgtttaggagatatttgcgtatgaatgaatagtgtttttattgttttggttttgttttggttaggatttttgttatttttatttttttttaagtgaggtgggagttggagttatgagatgaaagacgggaaagttatgaaaaatttatgataaagaatgttgtttttttggttaataatagtcgagtatcgggtgtttttttttatttgaaaatatatatagattttttaaagtatgttttttgttattaatttataatttaattatatgataattttttatggtttggagtgtggtgaatttttgtaaatattttatatgggttttaataaatgtgatgtagaattttatatatgtatatgtttattggattaagtatgtggattttgttattttaatttattacggttttttttatttttggattggtttatatataattaagagtggtgtatttatttatttattttttagagatagggttttgttttgttgtttaggttggagggtagtgaagtaattatggttcgttgtagttttaaatagttgggtttaagcgatttttttgttttagttttttagagtagttgggattataggtatgttttataatttttggtttatgaatggtatatttaaatttttaattgtgattgtaggttttttaatttgtttttaatttttaaattaatttttgttttttttgtatttaggttattaaggtgtttatttttgggaattattatagttttggtgaattgagtttttttttaatttgttttgagaatttttttgttttattttgttttgtttgatagtaataagttttatagttgtttttgggtatttgtttattgtatttttttttatttttttgtttttattttttttttgtatttatgttttagatgtagtttttgaaatgttataaatatagatttttgtttttgatttaatttgacgatttttgttttttaatttatgtttaatttatatggtagttaaagtgagtaaatttgtttttgtaagagataaatattgaagttttagtggtttaataaaatataggtttattttttagttacgtgtagtttaaggtaggttgggtattttgtagtttttttttaaaatatgttttaaggtggttaagttttattttgtatttttattattgaaaagtattttatgaatttttagttttgtaggtaggagagagaatttgggaaaggtatattgtttttatggttttggattagaaattatttgttatttttgtttatattttattggtaagaagtaaataatgattttatataggcgtacggggatggaaaaatgtacgttatttatgtgtgtaggaagatataatggtttggtgagtatatggttttgtttttgttgtattttgattgtgtttattgtgaatattgatgtatttgggtttgtttgtaatattttatttattttaatatttttattttttaaagtttttttgtttgtttgtttgtttgtttttgagacggagtttcgttttgttgttaggttggagtgtagtggtatgatttgggttggtttattgtaatttttgtttttcgggtttaagcgattttttttagtttttcgagtggttgggattttaggtgtatgttattatgtttggttatttttttttttttttttttgtattttagtagagacggggttttatcgtgttgtttaggtttatttttttgagtttaggtaatttgtttggttcggttttataaattgttaggattataggcgtgagttattatattcggttaagtttttttttttaatttttattgttttttttttttttaagtgttatcgatattttttttattttttttttgattggataagaattttagtatgtttttaaatttatttatatatttttttttttattaaattatttggttaatattattttttatattttttggtattttttagaatgcgttttttgattagaattttttttttaaaattttttagatgtgggaatttgtatagtaaattttttaaagttttgtatgtttgataattttttaaaattatattagtatttttgaataaagtttagttgtgtattatatattatttgaagtatttttttttttaatattttaaataatattattttaaatttttttttttgtatttaatgttatagttagaaaattttatgttagttttttatgttggaattttttagaatttttttattgtttttgatatttttaaattttgttagtgtgtttagagtgggtttttttttttttttgtaagatattatggattttttttattttttaattttgggaatttatttttttatttttttaattattttttttttttattttttgtttttgtgaaatttatataatttatatttggataattttttttttttttttttttgatttttttattgatgattttttaattttttttttttttgttttgaattagttttttagtgtagttttttatttttttgttttgttttttagttgtattttttttattatttattttattaatgtggtttttattttgattattatatatattttttatatttagaatttttaggtgttttttttatattttttatttttttatattataatagtttttgatttttaaagtgtatttttaatgtttattttaagcggttggtttatattttttattattttttttaaggatatagatggttttgtttgttgttttttttttgaggtgtcggtattttttaaaggtattattttgatttattagtggttatttgtgttggtgttatgtgtgtaaagagaaaggagggttagttggagttttaggttagcgtaaaattatagttattattttttgggtgttattttaggttaggattttagggtgggagtattaggaggcgtagggagtattgatagttggggtggtagaggaggtaatgattagggtagtttttagttttttttattttagtaggattttagtttggatttttttatttattttttaatagttggataggtaattaggattttgttatcgttttttgtagtagggagtaggtagtgattgtttaaggttaatatcggggaggtaagagtagaaggttttaggaatttttttatagttatagttagtaagtaatttagtttagaatattttttagttttattagggtttttttattatttgtttttttggaatgtatatgtatggtttatatttttttttagatggaaagggtttgtaagaagggattatggatgattgaatttttgttatataattttttttttttttttaaacgttagtacgttattaaataaataagttaatgataataaataaaagtgaataaagtggataattttgattttagggagaggtattgttattgggattagagtttaataatgaggtaaatatagattcgataaaaatttattaaagtgttttttaaaaatgatataaatttagttgttttaaattgtttaaaatgttgattttgaggtaaagttgtatttgttatgttttttggagtatgataagtttaggtaggtgttgggggatattttttattaaatatatgtttataggatatttgatgtgatttaggtattgtgtgttgttttgggagtatagaagagtaggatatgatttttttttttaaggattgtgttgttttgtgtagtagttataagttatttgtagttattaagttaaaaaaaattttaagtataaaatgtttt

SEQ ID NO: 25 - DNA, 8093 bp, Artificial Sequence
  Chemically treated genomic DNA (Homo sapiens)
ttatggaaggaaatgagattagttagcgagttgatatagaataaggtagtttaaaataaatttttttaaaaatacgaagaatagatattgaagggaagaggtgtttgtaaagattaagaaagtatatttggagatggtatttttttaaagttaaagttattaagtgtttaagtgttttaaggagggtaagattattaataaggatttagtatagtagagtaatttgagtggtaatacgggatattgggaatataaatttgttaagaaaattagtaggaatgagttataggatagtaattggtaaggatttaataattttttttttaatgtacgtattttaattatatttattgttataataggattagtaataattatatttatttaaaaaaaaaaagattgttatgtagttatagaattatttaatatagaaaatagtaaaatatatttttttttttttttttttttttttttttttttataaataagattagtttatagtaaattttttatagttaagggttaatttaaaatttttggtttatattttttttttatttaatgattatatgatgtaaattaattttattaatattttaagtaaaatatattggaattttataaaatgtataagattttaatatttaaggaattggggttagaaagtagaagtggtttttaggttttttagttttttttttaagtaataaagttttgttgtgaatatttaaagttattgggaaattatcggtagatttttttgtttttttttttcggttttttattatgttgtttttttagatatgtaagtttattttattaattaaaattttagtttgattatttttgataagtatttaatcgatatgtaattttttttttgttttaaatatgtataataggatagagtttttaaatttgatttaattattaatttttgatttataagtgttatggtgagttaatagaatttattaatgtttttattgtattttattagttaaatttagaaggttggaattagttttttttatttagtattttgttagtttgtttagtttgtatttttaattttgtttttaatggtaatttgttttattttttgaaataaaataatttatattttgggagggttaattttttattgtgttaggttgttttatgtattgtaggggtgagtgtttttaggtttaaatgttaatagaagtttttagtaaatatgataattaaaaaagtgtttttatatattttttagtattttttggaatgataggttattgtttttagttgaaagttattggtataattttggtttttaagtttttatgttatttattttaattgtttagatattaattttatttaaatttttagttatagtttggttttttgaatttgttggattagtaattatagattaaggtgttttaatagttaagataggattttggaataagagtttttaaattgtataatatttgagaggatttatgaatataaattgggttttgtttataattagttttatataatgaattttaagattgtttttttatggtgaatagaagtttggaaattattgttttggtataaagtagattattttagtagaaatatagaattattgtaatttgtgaataagattgtttttaaatatttttatttgtgtgttattttatatatagaatgtgtacgatagttttaaattttagaataaatttatttttagtatttaataaaatttgatattgtattattttaaaataaagtgtttattttaggtaggattttttaaaataaagtagtaatatttacgtagataagataaaaaagttaaaatattttatattttttaattttggagtgtaattttttttttttatcgtttttgatagggttaaatttgtgtttatagtaaaaaaaaaaaaaaaaagaattattaattggtaattattaagattttatatttattatagttttttaataggtaagttgataaaatagtttttagttattaaaaaaaaaatttaaggaaaatttttaataattagttttatttttaaattgtatgaagttttttatatttgaaatttaaaaatgattttaatgattttttttattagtaatgtgttattattgaggtgggtgatggggagggaagagggaagaaatttgttagtattattttcgaatttagaaatgtttaaaaaaaagttttaaatattttgatggttagataaaatatttttattgttatgtatgggttttttttttggaaatttatgaatttgttatgtgagtttttgtaaattggtttaaaagtatatttaaggagttgataatttaagattatatgaattagaattttaatattttattaaaataagagttgaaatttttggtatttatttttagaatatttaaaaaatagattgtaaatttaatttatattaatattaaatttttttaaaattaattatattataaaagataatgattttgttattaaattaagttttaaaaaaggtggtatttttatgttttagttttatgttgttatttgagatgaaaaaaaaggtaattgttagaattttaattgtgattagtttggacggttggtatttggtatttttttataatttaaattagtaaatttgaaaatttaaattaatttttgtttttagaattaaatttttgttgagttttttaattttgtattataaagttttatggattagatttattttttttttttataaggttattttaatcgggttttattttagttgtggtaattcgaaatagggtttggagatgtttatttgttaatggttgatttaaagtgtgttggtttcgagttaaatatgaaaaagtttttttatagatttggttattattaaataaggatgttattttataggtaatttttttgataattgggtaggatttagtagataatttagtataaaattgttttaagtttttgattttgtatttattttaaagattagtgtttgtttgaagttttgttagttttatttttattgaaataggtgtatatttaggtttaaagttaaatggatttgaaaaaagttttaagttttttttaatgaatttgaggtttttaaaatgttttttaaattttttttggagacgatagattattatttgatatttattaggattaaatatttttttattttttttattttgttgttttagtttattaataatttttttgagggtaggaaagtttgttagatttttttttttaatatgtttttgaaataaatttagtttaatttcgaaagtataaatatggttaaaggtagtagtagtaaagattttattaattcgtaattttttattgagttttcgaaggtgttttataatgtttattaagaagttaaagttataaagttattgtttgtttgagaagtggattgttgttgtttttattgaaattaagaacgtttttatttttttttttagagagaatattagttttaaagtttttttttttttaagttaattgtttagatatcgtttattaatttttttattatgttttgatttagatttcgttagtaaagtttgaaatttaggtcgtttaacgtttttggttttaattaaaattatttattcggatatggtatttatgatttgattaatatttatattataggagtttaatagttttaagtgaagaaattttgaataatgaatgatattttaatagttggggtttacggtttttttttttatgtatgagacgagttttgagtttttattaattatttttaaagtatgggtcgtggttagtttaattattttttgtaagttaagttttgttgtttgtagggattttaggattgtcgatatgagcgtattaatattgaaatgatgagttaggttgattatggttagaagatttttttgtatttttaatttagggtttatatcgcggataaagattaggaggtagtttttataggttataaaagtttggtcgtttaaggtaagagaataggttttaaagtttttggttcggttaaaaagttggttgcgtagatttttgttaatgtttaggattttttgttttgtgatatttggagataagttaacgttttgtaggacgtttatatgttcgggtagtattttttttagtaatatttttatgtattggtatataaagttttttttattttagtcgcgattttttaaggttaagaggcggtagagttcgaggtttgtacgagtagttttttttttaggagtgaaggaggttacgggtaagtcgttttgacgtagacgttttattagggtcgcgcgttcgtcgttcgttatatatcgttcgtagtattcgtgtttagtttcgtagtggcgtttgacgtcgcgttcgcgggtagttacgatgaggcggcgatagattaggtatagggttttatcgtttttcggaggttttattattaaataacgttgggtttattcgggtcggaaaattagagtttcgtcgatttttattttgttttttttgggcgttatttatattttgcgggaggttataagagtagggttaacgttagaaaggtcgtaaggggagaggaggagtttgagaagcgttaagtatttttttcgttttgcgttagattattttagtagaggtatataagttcggtttcggtatttttgtttttattggttggatatttcgtatttttcgagtttttaaaaacgaattaataggaagagcggatagcgatttttaacgcgtaagcgtatatttttttaggtagcgggtagtagtcgttttagggagggacgaagagatttagtaatttatagagttgagaaatttgattggtatttaagttgtttaattaatagttgtcgttgaagggtggggttggatggcgtaagttatagttgaaggaagaacgtgagtacgaggtattgaggtgattggttgaaggtattttcgttgagtatttagacgtttttttggtttttttggcgttaaaatgtcgttcgtggtaggggttattcggcggttggacgagatagtggtgaatcgtatcgcggcgggggaagttatttagcggttagttaatgttattaaagagatgattgagaattggtacggagggagtcgagtcgggtttatttaagggttacgatttaacgggtcgcgttatttaatggcgcggatacgtttttttgttcgggtagaggtatgtatagcgtatgtttataacggcggaggtcgtcgggttttttgacgtgttagttaggtttttttttttttcgtagatcgtgtgtttttttatcgttttttttcgagattttttaagggttgtttggagtgtaagtggaggaatatacgtagtgttgttttaatggtatcgttaattaagtaaggaagttatttaatttaaaattatgtatgtagaatatgcgaagttaaaagatgtataaaagtttaagatggggagaaaaatttttttttagagggtattgtgttattgtttttttgttttttatttattttagaaattatttgtttatatttaaaggtataatttattttgagttttttttaaaataaatcgtttgtagttttaggataggttgatgtattttgggtttgatttttgattattttattgttaaattagtgattttttttagtgtttttttgttttttatttcggaggacgtatttcgaagatattagattttatgggttatttttggattttgaagtttataattgtgataaaaaatgtgaagggaagagatttgaaatatgtggaaggaaaagtgagtgtagattataaatttttaaaaagataagtttaaaatatatttaaacgttatgttagattattttgttaaaattagttgttagtgacgttcgtacgttaatagaaaaaagaatgttttagtttggagtggtaggtttttagagggatttattgtgaaagtataaattatttagggtaatgggattgagagaatagtgggtagaaaggattattgaaggaaaggaagagaattggaaggtagatgaaagaaggagtaagaatttggggatgtttttttttttttatttgtaatagtagtaatagaagtaatggtagattggtttttgtttttattgtgttagaatgaattgataggataattgggtttattattgtattgtgttagaatattgtaaaataaaattaaatatattagtttggtggtttgtaattaattatttaagtggagatttttattttttttttattttttttttagacggagttttattttgttatttaggttggagtgtagtggcgcgattttagttgattgtaattttttttttataggtttaagggagatttttttgttttagtttttcgagtagttaggattataggtatgtgttattatatttggttaattttgtatttttagtagagatgggatttttttatgttggttaggttggtgttaaaattttcgattttaggtgaatcgtttgttttagttttttaaagtgttgggattataggcgtgagttatcgcgttttgtagttttttgtatttttaatagagatagggttttattatgttagttaggatggtttcgattttttgattttaggtgatttgttcgttttggttttttaaagtgttgggattataagtatgagttatcgcgttcggtttaagtggagatttttatatggagtttagttatattttttttaatatataagttgagatgattaatataattttaatataggggtttatgagaaatgtttgtaatatttaagtaatttattgtttttttttttttttttttaagatgaagttttattttgttgtttaggcggaagtgtagtggcgtgattttggtttagggtaatttttgttttttggttttaagcgatttttttgttttagtttttcgagtagttgggagtataggcgtgtatgattatattcggttaatttttttatttttagtagagacggggtttttttatgttggtcgggttggttttgaatttttgattttaggtgattcgtttattttagtttttttaagtgttgggattataggtgtgagttttcgtgtttagtttattattttatttttgaataaagaattgtttgtgtggggaatagataatttttttttatgtagtttttgttagaaaatttgttttttttagtagttggtttgtgtttataggttattttttgaaagtataaaaaatttattgattttttttttttgggtttttttttttttttgagatagagttttgtttttgttgtttaggttggagtgtaatggcgcgattttagtttatcgtaatttttattttttgggtttaagtgatttttttgttttagttttttgagtagttgggattataggtatgcgttattatgtttggttaattttgtatttttagtataaatggggtttttttatgttggttaggttggttttaaatttttgattttaggtgatttattcgttttggttttttaaagtgttgggattatgggtgtgagttattgcgtttggttagaaaatttattgattttttaaagatttattaattttttgtattattttttttttttttttttatcgtaaatataaaagggaatagtagagaaaattatttagaattttattttttagtgatattatttagtgatattttattagagttatttaggaatttgaggttgaataaagtttaggtaaaagtaaaattagttgagaagagatatttgttaaaagaaatttatttttaattttatttgttgttttttttagaggaatagaaatagtgttgaatgttttattagaaatgatggttgttttgttcgtttttttttttttttttatataatatgtaaatttatatagtgtatgagtttgtaagataaaggaaaaatacgttaatgaggtattattgtttgtatttggagtttgttattattgtttggtttatattaaaatatgtatattagagtagttgtagattgataaattattttttgtttgatttgttagt

SEQ ID NO: 26 - DNA, 8093 bp, Artificial Sequence
  Chemically treated genomic DNA (Homo sapiens)
attggtaaattaaatagaaaataatttattagtttgtaattattttaatgtatatattttaatatgagttaagtaatgataataaattttaaatataaataatagtgttttattaacgtgttttttttttgttttataggtttatatattgtatgagtttatatattgtgtgagagagagggaagagacgggtagagtaattattatttttaataggatatttagtattatttttgtttttttaggaaagatagtaagtgaagttaaaaatagattttttttggtagatgtttttttttaattaattttatttttatttgaattttatttagttttaggtttttaagtgattttaataaaatgttattaaataatgttattaaaaaataaaattttgaatgattttttttattatttttttttatatttacgatggaggggaaaaaaaaaagtaatgtagaaagttaataaatttttaggaagttaatgaattttttggttaggcgtaatggtttatatttataattttagtattttgggaggttaaggcgggtggattatttgaggttaggagtttgagattagtttgattaatatggagaaattttatttgtattaaaaatataaaattagttaggtatggtgacgtatgtttgtaattttagttatttaggaggttaaggtaggagaattatttgaatttaggaggtggaggttgcggtgagttgagatcgcgttattgtattttaatttgggtaataagggtaaaattttgttttaaaaaaaaaaaaaaatttaaaaaaaagaagttaataaattttttgtgtttttaaagagtagtttataagtatagattaattgttagagaaaataaattttttagtaggggttgtatgagaaagagttatttattttttatatagataattttttatttagaaataagataataggttgggtacgggggtttatatttgtaattttaatatttggggaggttgaggtgggcggattatttgaggttaggagtttaagattagttcggttaatatggagaaatttcgtttttattaaaaataaaaaaattagtcgggtgtggttatgtacgtttgtatttttagttattcgggaggttgaggtaggaagatcgtttgaaattaggaggtagaggttgttttgagttaagattacgttattgtattttcgtttgggtaatagagtaagattttattttaaaaaaaaaagaaagaagataataagttatttaaatattatagatattttttatgagtttttgtattgaagttgtattagttattttaatttatatattaaaaagagtataattggattttatataaaaatttttatttgagtcgggcgcggtggtttatgtttgtaattttagtattttgggaggttaaagcgggtagattatttgaggttaggaaatcgagattattttggttaatatggtgaaattttgtttttattaaaaatataaaaaattgtagggcgcggtggtttacgtttgtaattttagtattttggaaggttgaggtaggcggtttatttgagatcgagagttttgatattagtttgattaatatggagaaattttatttttattaaaaatataaaattagttaggtgtggtggtatatgtttatagttttagttattcgggaggttgaggtaggagaattttttttgaatttgtgaggaggaggttgtagttagttgagatcgcgttattgtattttagtttgggtgataaagtgagatttcgtttaaaaaaaaaataaaaaaaaaataaaaatttttatttaagtaattaattataagttattaagttagtatgtttagttttgttttatagtattttggtatagtataataataggtttagttgttttgttaatttattttaatatagtagaaataaaagttagtttgttattgtttttgttattattattataagtgaaaaggaaaaaatatttttaggtttttgtttttttttttatttattttttaatttttttttttttttttagtggttttttttatttattgtttttttagttttattgttttgaatagtttatatttttataataaatttttttagaaatttattattttaaattgaagtatttttttttttattaacgtacggacgttattaataattgattttaataaaataatttgatataacgtttaggtgtattttgggtttgtttttttggaagtttatagtttgtatttatttttttttttatatgttttaaattttttttttttatattttttgttatagttataagttttaaaatttaaggatgatttataaaatttggtattttcgaagtgcgtttttcgaaataaaggataggaaaatattaagaggggttattaatttaataatagggtaattagaagttaagtttaaagtgtattagtttgttttaaaattataaacgatttgttttgaaagaaatttaaaatgaattgtgtttttggatgtgaatagatgatttttggaatgaatgaaaagtaagaaaatagtaatatagtattttttgaaaaaaggtttttttttttattttaagtttttatatattttttaatttcgtatgttttgtatatataattttaaattaagtggtttttttatttagttaacggtattattaagataatattacgtatatttttttatttatattttaaataatttttaaaaggtttcgggggagagcggtaaagaaatatacggtttgcggaaaaggagaaggtttgattggtacgttagggaattcggcggttttcgtcgttgtgggtatgcgttgtatatgtttttgttcgggtaaagaggcgtgttcgcgttattgagtgacgcggttcgttaagtcgtagtttttaagtgagttcggttcgatttttttcgtattagtttttaattatttttttgatagtattagttggtcgttggataatttttttcgtcgcgatgcggtttattattgtttcgtttagtcgtcgaataatttttgttacgaacgatattttggcgttagaagagttaaggaaacgtttagatgtttaacggaagtgtttttagttaattattttagtgtttcgtgtttacgttttttttttagttgtagtttacgttatttagttttattttttagcggtagttattgattggatagtttgaatgttagttaaattttttaattttgtgggttgttgggttttttcgtttttttttgaagcggttattgttcgttatttagaaggatatgcgtttgcgcgttagagatcgttgttcgttttttttattggttcgtttttaggagttcggggaatacgaaatatttagttaataggagtagagatgtcggaatcgggtttgtgtgtttttgttgaggtgatttggcgtagagcggaggaggtgtttggcgttttttaggttttttttttttttttgcggtttttttaacgttggttttgtttttgtggtttttcgtagaatgtggatgacgtttaaaagaagtaagatggaagtcgacgaggttttagtttttcggttcgagtggatttagcgttatttggtggtggagttttcggagggcgatggggttttgtgtttggtttgtcgtcgttttatcgtagttattcgcgaacgcgacgttaggcgttattacgaggttgagtacgaatattacgagcggtatgtggcggacggcgagcgcgcggttttggtggagcgtttgcgttagggcgatttgttcgtggttttttttatttttgaagagagagttgttcgtgtaggtttcgggttttgtcgttttttggttttgaagggtcgcggttggggtgagggggattttgtatattagtgtatggaggtgttgttgagagaggtattgttcgagtatgtaagcgttttgtaaggcgttgatttatttttagatattataaggtagaggattttgagtattgataggaatttacgtaattagttttttaatcgagttagggattttaaagtttatttttttgttttggacgattaggtttttgtggtttatgagaattattttttggtttttattcgcggtgtaggttttgagttggaggtgtaagaagattttttgattataattaatttgatttattattttagtgttggtgcgtttatgtcggtaattttagagtttttgtagatagtagggtttagtttgtagagaatggttggattgattacgatttatattttgaggatgattggtgagaatttaggattcgttttatatatgagagaaaaggtcgtaagttttaattgttggaatgttatttattatttaggatttttttatttggaattgttgagtttttatgatgtagatgttaattagattataaatattatattcgaatggatagttttgattaagattagaggcgttaggcgatttgaattttagattttattaacggaatttgaattagagtatggtgaaagggttaatggacgatgtttgaataattggtttaggagagggaaaattttaaaattaatattttttttaagaaaagaaatggaagcgtttttggttttagtaggggtaataatagtttattttttagataaataatggttttgtgattttggttttttggtggatattatggaatattttcgagaatttagtgaagaattacgagttagtaaagtttttgttgttgttgtttttgattatatttgtattttcgaagttaagttgaatttattttaaagatatattgaggaaaaaaatttaatagatttttttgtttttagagaagttgttgatgagttaaaatagtaaaataaggaagatgaaaaaatatttgattttgataggtattaaatggtgatttgtcgtttttaaaaagaatttgagagatattttaaggattttaggtttattaaaaaggatttagaattttttttaaatttatttaattttaaatttgaatatgtatttattttagtgagggtggagttaataaaattttaggtaaatattaatttttggaatgaatatagaattaaagatttggggtagttttatgttggattgtttgttgaattttatttaattattaaaggggttgtttgtaaggtggtatttttgtttgatagtaattaaatttgtgaaaaggtttttttatatttgattcgaaattaatatattttgagttagttattaatagatgagtatttttaagttttgtttcgggttgttataattgaaatggagttcggttgggatgattttgtgagagaaagaaatgaatttaatttataaggttttgtagtataagattgaaaaatttaataagaatttaattttaaaagtaaaaattggtttgagtttttaagtttattaatttggattgtgagaaagtattaagtattagtcgtttaaattgattataattaaaattttgatagttgtttttttttttattttaaatggtagtatgggattgaaatatgagaatgttattttttttaaaatttagtttagtgataaagttattgttttttatgatatagttaattttaaagagatttagtattaatgtgagttgaatttgtagtttgttttttaggtgttttgaagataaatgttaaaaattttagtttttattttaatggagtgttaaaattttgatttatatagttttaaattattaattttttaaatgtgtttttgaattaatttgtagaagtttatatagtaagtttataagtttttaaaaaggaagtttatatataatagtggaggtgttttgtttaattattaaaatgtttgagatttttttttaaatatttttgagttcgaaggtaatattgatagatttttttttttttttttttttattatttattttagtgataatatattattgatagaggaagttattagaattatttttaagttttagatataggagattttatgtaatttggagataagattaattattgggggttttttttggattttttttttaataattgggggttattttattagtttgtttattaaaggattatggtaagtatagaattttaatggttgttagttagtaattttttttttttttttttttattgtagatataagtttggttttattaaaaacgatgaggaaaaaagattgtattttaggattaggaggtgtgagatattttagtttttttgttttatttgcgtgggtattgttgttttattttaaaaaattttgtttaaagtaaatattttgttttaaaatgatatagtattagattttgttagatgttagaaatggatttattttaaaatttggaattgtcgtatatattttatatgtaagatagtatataagtagaaatatttaaaagtagttttatttatagattgtagtaattttgtatttttattaagataatttgttttgtgttaaaatagtaatttttaaatttttgtttattatgaaaaggtaattttaaagtttattatgtaaaattaattataaataggatttaatttatatttatagatttttttaagtattatataatttaaaaatttttgttttaaagttttgttttaattattgaaatattttaatttgtggttattaatttagtaaatttaaggaattaggttatgattaagaatttaggtggaattgatgtttgggtaattaaaataaatggtataagagtttaaaaattaaagttgtgttagtggtttttaattagaggtagtaatttgttattttagaggatgttgagaaatgtgtaggggtatttttttggttgttatatttattaggggtttttgttggtatttaagtttaaagatatttatttttgtagtgtatgggatagtttggtataatgaagaattagtttttttaaaatgtagattattttattttaagggatagggtagattattattagaagtaaaattaaaagtataagttgggtaaattgatagaatattagataggagagattaattttaattttttaaatttggttagtaaagtgtaataaaggtattgataagttttgttagtttattatagtatttgtaaattaggaattaataattgaattagatttaagggttttgttttgttatatatatttaaggtagaaaaaaagttatatgtcgattaggtatttattaagaatggttaagttgagattttggttaatagagtaagtttatatatttagagaaataatatagtggaaaatcgaaaaaaaaaaatagaaaaatttatcggtaattttttaatagttttgaatatttatagtagagttttattatttgagagaaagattggaagatttgaaagttatttttgttttttaattttagttttttaaatattgaaattttgtatattttgtgaaattttagtatgttttgtttaaggtgttaataaaattagtttgtattatgtagttattgagtgagggggagatataagttaaggattttaaattgatttttagttatagagaatttgttataagttagttttgtttgtaaaaaaaaaaaaaaaaaaagaaaaagaaaaaagtgtattttattgttttttgtattaagtaattttgtaattgtatggtagtttttttttttttaaataaatatagttgttattggttttgttgtagtagtgaatatagttaaaatacgtatattaaaaaaaaaattattaggtttttattagttattgttttatagtttatttttattagtttttttgatagatttgtatttttagtgtttcgtattgttatttaaattgttttattatgttaagtttttgttaatagttttattttttttgaaatatttgaatatttgatgattttagttttgaggagatattatttttaggtgtgtttttttagtttttgtaggtattttttttttttaatatttgtttttcgtatttttaaaaaaatttgttttagattgttttgttttgtgttagttcgttagttgattttatttttttttatgg

SEQ ID NO: 27 - DNA, 6246 bp, Artificial Sequence
  Chemically treated genomic DNA (Homo sapiens)
ttttgtatatttgtattttatataataatattttgtgtaatttttttttaaatgtagaatattgatattggagaatgttttttatatattttaagtgaaaaaggagtaaaaattatataatgtattattttatttttttaataaaatgtaaatgtgtatagtaaagatatagaggtgttatagtgttagggaaaaggggtgtaagattagtgtttgttttttattttttgttttgtttataaattttttatattaaaaatataaattttaaatgaaaataatggaataaatataaatttttattttataattaattaaaatgatagtaattgaattttttaaagttttaaatttattaaaatgggagaaatggatgatagtattagcgtttgaaaggtggaaagtggagggacggtgggtagattatttggttgatttaagaaaattgaattttaggttagttgagatttatgttgatttatagaattttaagaatgtttaggaattgggagaagattaaggatattagaagagaagggggtgaaaataaggaaagttgttgaaatttagtttaagaaatagttagatatttatttttgtttattaaagtcgagtgatttttttgtagtagggtttttttcggataggatatttggattaagaaatattagatatagtagagggcggtcgaaatatgttgaaattaggaatagttaatagatgttgaggtttttattttagttttttttttatttttgttgttggaatgttggagatagggagaattttttttgcgcgagttgatttgtttgttaaaaaaacgataaagaaattgttataggaggttttttaagtgaaaatagttagttatttgttttataggaaatagtttttttttatataattatttttagagatttttgttttaatatgtgtaggtaatttaggattatttaacgtgtaaggaaagtttataagatggaaaaaaaattttttttgaggtagggtttggttttgttatttaggttggagtgaagtggtgtgattataatttattgtagtttcgatttttgagtttaagtgatgtttttatatagttttttaagtagttgggattataggtatgtataattatgtttggttaagttttttttatgttttgtagaagtaaagtttttttatgttttttaggttggtgttaaatttttgggtttaagcgatcggttttttaaagtgttggaattataggggtgagttatcgcgtttagtttaaaataattttttaaagaaaatttgtagaaaataaagattatgtatgaaaaaggaaatttagaagatattaatgaaataagaatatagtgttgttagcgtgtatgtgtatatgcgtatatatatataaagaattaaatatttttaggaagataaagttatgagaatattttagagaagagaaattttttaaatggaaaatagaataaaaagaaaattaaaggataagtttaagaggtatatagttaaaaaaaatggtagttttaataagagagaataaagaagaaaagttataaaatgttttaatttaagtgtgaatataaaaatatattatttttatagtaagtgagaaaaatagggtgtaaaaggtgtatatgatgttattttatatgtagggataagggaaaataagattatatatttatagttgtttgtatttatataaattaataggatattaaaaaaaaaaaaaaataatatttaagaaaaatagttatttgtgagggaaggtggagattttattgaattttttatatatatagttgatttttgaatagtaggttttgaattgtatagatttatttatttacggatttttttttgtttttgttatttttgagatgataagatcgattttttttttttttttttttcggtttgtttaacgtgaagatagtgacgttgaagatttttgtgatgttttatttttatttaatgaataggaaatatatttttttttttttttttgtgatttttttaataatttttttttttttttttttttttttttaagacggagttttatattgtcgtttaggtttaagtgtagtggcgcgatttcggtttattgtaagtttcgtttttcgggtttacgttatttttttgttttagttttttgggtagttgggattataggcgtttattattacgttcggttaatttttttgtatttttagtagagacggggttttatcgtgttagttaggatggttttaattttttgatttcgtgattcgtttatttcggttttttaaagtgttgggattataggcgtgagttatcgcgttcggtttataaataatttttaaaagatagtaagggatatagtagggtagtaagtgttttatttataagaggagtagtaatgttagaggtttatagagtacggatttttagcgttgtcgttttatataattagtttttttgatttttaaaattatttgtattcgtaatttttttaaaaataaaaatttaaaaaattaaatttttttatttataaaaataatttttttaggttttattttttttgattgggtattatgtttttgttaacggagatttagagtttagagaaattcgaaaaagtaattttagtttttttaggatgagttggtcgggaggaagggaggttttaattttagcgtttcggggttagagtaaagcgaagaggttttttatggttataagcgggcggtttacgtagcgtattgtaggtaggtgcgagttatatgcgttaagtgttcggagcggttttttggtagttagtgttaattaaaattattcgtacgggagtggattttcgttgataatttagaaataagtaatagattttttgatgtagttatttgtgtcgcgttttttcgtatcgttcgttacgttttggtttttggagattattttttagggtaggggttgtcgttcggtcgggttcgcggggtttttcggtttgatatggtcggtgttggagcggtacgtgcgcgtttcggtttttcggtcgttttcgtttttcgtcggtgcgtatcggcgttcggggagtcgttggttcgggtgtttagtcggtttttgttttgtttggcgttcggatcgttatttttgtcgttttttcgttagttttcgtagtttttagattggtcggtttgcgcgtttatttttgtttttcggatcggttatcgtcggaggtcgcggaggagggttcggtcgcgtagatttcgtttatcgggtttatttttcgttatataaggttatttttttattttcgcgggttatcgtcgtcgtaatcgtcgcgttagcgtttttttttacgcgcgggggcgtttttgtttatcgttttcggtagggtttttggtggttatgggggataaggggcgttgatttattcgggcggggtttcgggagttgtatagattaaggtagtttttcgtttttttttttattacggagattttgtgggagatgtcgtgggttttttattatagattaggaaataggttcgtagaggggttatacggttaagtagcggtattttaggtattgggggttttcgaggggaaggggtagatttttgggagttagagttagtagttgggttgggaagtttcgagtgtggatagagagggtgggaatgacgttttttgtgggaagagagggtgggtaagtttgggatgtttttgagcgggaatttagtatgttttgtgaggagggttataagtatatttttgtgaggaggttgagttttatcgaggataggacggagggagtttgagtaggtagagagggggtttggggaggcgttggttcggggaggaagtgggtaggggagaaattttgatattaatatttaataggtaaatgtcgtggtttttgttgtgggggtttttggaggatttttaggaaaacgagggaagagtaggaaaaggcgatatggttgtaggggttaagtttaggagtcgttttttatagtatttattttgtagaagggaaatttgaggtttttagacggtaggggttgattttgtagagattggtgagtaaaggggattattttaagttttagtggtattaggaatatttataatttttgatttggattaaggttgttagtttggtttagttaagagttttttagaaggatggtttatatattttaaattaaaggggttagatacgtgtatattatttttagttattttggaagttgaggtggggggatcgtttgagtttgggagttggaggttagtttaggtaggtaatatagtgagattttatttttaaaaaaataaaataaaataaaataaaaaaatattaaaaaagtttttagaaagatttttgaatttttttggattttttagtggagatttggaaatttgaattttgataattttttttatagtggggttaaggaggaattaggtaagttaaaagaagtgaattttatttttttattgtttgtttgaattttgtatttaagtaagtgttatttaagtaatttaagagattggtttatcgaaaaaataaaattttttaaatttttatagttggtagattgtggttatagttatagtgtattaagattatttgtttagtatttttggtgatttaaaagggtttgaggataggagtttagagttgggttagttgtttaggtatttagggttgttataggtaaaattgttggaatttagggtagtattgtaaatgttacgtcgtttttagggttttttgtttgtcgttggaattaaatttatttagattttggaaattttgttttggattttttttaataagtttatgagaaattaaatttttttttttatgcgatattggattttttataaagtaaaattaagatgagtaaagatgtggtttttagatagtgtttgaaaaagtagagattatggtgttaggcgttattatttgggtttataaaagttgttataagacgttaaggttataagttatttagtttatgtattcgttttttaatttttttttgttggtattgggttttatggcgtttttgttgattacggttattgtttttatttgttttggcggttttgtttttttaggttttgtgtttttttttatagtttttagggagtttattgaggagttggttaatattatttagaattagaaggtgagtgtcggttagttagggttttagttatgagggttttagggtgggtgatttttaagatgaggttatgagtaggttgggtttggttttaagatgtttgtaggttaggaaaaatttttatggattaaggttcggtttagttatgagggagagaggagttgggttggggggtttagtattgtggatggatttatggaggtgtttggtagattttttagggattatttgtttttttggtttggttttgtttgttattgttagtttttatttagttatttttgaatagaggatagtagagaagggttagtatttttttagaattatgtggtatttgttaattggattttgattataataatgtagttattttttttagtattattataggttcgtttttataggaggattttttagtagagttcgttttttgttttattagtaatagtttatatgtttgagtattgtttatattaggtttggtgtacgtgttttatgtgttattttattattgttagttattttaagaggtaggtacgatgaatttattttgttaaggtttagtgaggttaagtgatagaggttggatttaagttaggtttggttaatattagagtgtttatgtttttaattgtagtgtttttttattattagaaggtagggtatttaatatattagatttttatcgttttttatttgatttgttttggttaatagtggtttaggttatttttattttattcgtttttattttggtttttttcgtaggtttttgtttttttgttttgattatggtaagttttgtatgtagtttgttttttattagtggtgttaattttttttttttagttttaagattttaaatagtgggattttatttttatgtttgttgtttaaagtagaaaacgaagtttaggaatgttgaggggttgttaggtttgtttttgtgttatattagggatgtttgtggggtttgtgttggggtagatttggtttgggttgttagggtaggtttataatttttgttagtattttgtttattgttattttgtttttatagg

SEQ ID NO: 28 - DNA, 6246 bp, Artificial Sequence
  Chemically treated genomic DNA (Homo sapiens)
tttgtgggagtaaagtgatagtgagtagagtgttggtaggggttgtgggtttgttttggtagtttaggttaggtttgttttagtataggttttataagtatttttggtgtggtatagaggtaggtttggtagttttttagtatttttgagtttcgttttttgttttgaatagtaggtataggggtgaggttttattgtttagggttttggagttgagagaaaaaaattgatattattagtaagggataagttgtatgtaaggtttgttatagttagggtaggaggataggggtttgcgggaagggttagggtggggacgagtgaagtaggagtggtttgggttattgttgattaagataaattagatgggaggcggtggggatttggtgtattaaatgttttgttttttgatggtgagggaatattgtagttaggagtatggatattttggtgttggttaggtttggtttgaatttagtttttgttatttaattttattgaattttagtagaatgggtttatcgtatttgttttttgaggtggttggtagtgatgaaatgatatataaagtacgtgtattaggtttggtgtaagtagtgtttagatatgtgagttgttattagtggggtaaggagcggattttattaaggaatttttttgtaagggcgggtttatgatggtgttggggagaatggttgtattgttatggttaaaatttagttggtaaatgttatatggttttgggagggtgttggtttttttttgttgttttttgtttaggaatggttgagtaggagttggtagtggtagataaggttaggttaggagagtaggtagtttttggggagtttgttagatatttttataggtttatttatagtgttgagttttttagtttagttttttttttttttatggttgggtcgggttttggtttatggagattttttttgatttataggtattttaggattaggtttagtttgtttatgattttattttgggaattatttattttggagtttttatagttaggattttggttagtcgatatttattttttggttttgggtgatgttgattagttttttaatgagttttttgagggttgtagagggaggtatagggtttggggaggtaaagtcgttaaggtaagtgagagtaatgatcgtggttaataaaagcgttatgaggtttagtgttaataggagaggattgaggagcggatgtataggttgggtggtttgtggttttggcgttttgtggtagtttttataggtttaagtggtgacgtttgatattatggtttttgtttttttaggtattatttagaaattatatttttatttattttgattttattttgtggaaaatttagtgtcgtataaaggaaagagtttgattttttatggatttattgagaagggtttagggtagagtttttaagatttgggtgggtttaattttagcggtaggtaaggggttttgagagcggcgtggtatttgtaatgttgttttgagttttagtagttttgtttgtgataattttgagtatttggatagttgatttaattttgagtttttgtttttagatttttttgggttattagaagtgttgagtagatagttttagtgtattgtggttgtgattatagtttattagttatgggaatttggggagttttattttttcgatgaattagttttttaaattatttaagtaatatttgtttggatataaaatttaaataggtaatagaagagtaaagtttattttttttggtttgtttaatttttttttggttttattgtgagagggattgttaaagtttagatttttaggtttttattgagagatttagaaagatttagaggtttttttgggagtttttttggtgtttttttgttttgttttgttttgtttttttggagatggggttttattatgttgtttgtttaggttggtttttaatttttagatttaagcgatttttttattttagtttttagagtggttggaagtagtgtgtacgtgtttggtttttttaatttaaagtgtatgggttatttttttgggaaatttttaattgggttaggttggtagttttagtttaggttagagattgtaagtgtttttagtgttattggggtttggggtgattttttttgtttattagtttttgtaggattaatttttgtcgtttgggggttttaaattttttttttgtagaatgagtgttgtggagggcggtttttgggtttggtttttgtagttatgtcgtttttttttgtttttttttcgtttttttagaagttttttagaaatttttatagtagaggttacggtatttgtttgttgggtgttgatgttaagattttttttttatttatttttttttcgaattagcgtttttttaggttttttttttgtttgtttaggtttttttcgttttgttttcgatggggtttaatttttttataagggtgtgtttgtgattttttttataaggtatgttggattttcgtttagaggtattttaggtttgtttattttttttttttatagggaacgttatttttattttttttgtttatattcgaagttttttagtttagttgttggttttgatttttagaagtttgtttttttttttcgagggtttttagtgtttggagtgtcgttatttggtcgtgtgatttttttacgggtttgttttttaatttgtagtagagggtttacggtattttttatagggttttcgtgatgggggaaggagcggggaattattttggtttgtgtaattttcggagtttcgttcgggtgagttaacgttttttattttttatggttattaaaagttttgtcgggagcggtgggtaggggcgttttcgcgcgtgggagaaggcgttggcgcggcggttgcggcggcgatggttcgcggagataggggggtggttttatgtaacgggagatgggttcgataagcgggatttgcgcggtcgggttttttttcgcggttttcggcggtggtcggttcgggaggtaggggtgggcgcgtagatcggttagtttggaagttgcggaggttggcgagggggcggtaaaggtggcggttcgagcgttaggtagggtaagggtcggttggatattcgggttagcggtttttcgagcgtcggtgcgtatcggcgaggggcgggagcggtcgaggggtcgaggcgcgtacgtgtcgttttagtatcggttatgttaggtcgagggatttcgcgggttcggtcgagcggtagtttttgttttggagggtggtttttagggattaaggcgtggcgggcggtgcggagaggcgcggtatagatggttatattagagggtttgttgtttgtttttagattgttagcggggatttattttcgtgcgggtaattttaattaatattaattattaaagggtcgtttcgggtatttggcgtatgtggttcgtatttgtttgtaatgcgttgcgtgggtcgttcgtttatggttatggggagttttttcgttttgttttggtttcgaagcgttgggattgggatttttttttttttcgattagtttattttgggaaagttggggttgttttttcgggtttttttggattttgggttttcgttggtaaagatatgatgtttagttaggaggagtaaggtttgagagagttgtttttgtaagtgaaaggatttaattttttagatttttatttttaggaaagttacgaatgtagataattttaaaaattaagaaggttgattatgtaaaacggtagcgttgggaattcgtgttttatgggtttttggtattgttgttttttttgtgagtgaggtatttattgttttgttgtgttttttattgttttttaaaggttgtttataggtcgggcgcggtggtttacgtttgtaattttagtattttgggaggtcgagatgggcggattacgaggttaggagattgagattattttggttaatacggtgaaatttcgtttttattaaaaatataaaaaaattagtcgggcgtggtggtgggcgtttgtagttttagttatttaggaggttgaggtaggagaatggcgtgaattcgggaggcggagtttgtagtgagtcgaaatcgcgttattgtatttaagtttgggcgatagtgtgagatttcgttttaaaaaaaaaaaaaaaaaaaaaaaaaggttgttaagaaaattataaggaaggaggaaaaaatatattttttatttattaagtggaggtggaatattataaaggtttttagcgttattgtttttacgttgagtaggtcgaggaggaagaagaggaggggtcggttttgttattttaggggtggtagaggtaggagagaattcgtggataagtggatttgtgtagtttagaatttgttgtttaagggttaattgtgtatgtaaaaaatttagtggaatttttatttttttttataagtaattattttttttaggtgttgtttttttttttttttggtattttattagtttatgtaaatataagtaattgtgaatatatggttttatttttttttgtttttatatgtgaagtggtattatatatattttttgtattttgttttttttatttattataaaaataatatatttttgtatttatatttagattgggatattttatgattttttttttttgtttttttttattggaattgttattttttttgattatatattttttggatttgttttttaattttttttttattttattttttatttaaaaaattttttttttttgggatatttttatagttttatttttttgagggtatttgattttttgtgtgtgtgtgcgtatgtgtatatgtacgttaatagtattatgtttttgttttattgatattttttaagtttttttttttatatataatttttattttttgtaagttttttttaaaaaattgttttgaattgggcgcggtggtttatttttgtaattttagtattttggggggtcgatcgtttgagtttaggagtttgatattagtttgggaaatatagggagattttatttttataaaatataaaaaaaatttagttaggtatggttgtgtatatttgtgattttagttatttgggaggttgtgtgggagtattatttgagtttaggagtcgaagttgtagtgagttgtgattatattattttattttagtttgggtgatagagttagattttgttttaaaaaaaattttttttttattttataggttttttttgtacgttaggtaattttggattgtttgtatatgttaaaatagggatttttgagggtaattgtgtgggagggggttgttttttatagggtaggtggttgattgtttttatttggggaattttttgtggtagtttttttgtcgtttttttggtaggtaggttagttcgcgtagaaaagattttttttgtttttagtattttagtagtaagggtggagagagggttggggtgggggttttagtatttgttgattgtttttgattttagtatatttcgatcgttttttattgtgtttagtgttttttggtttagatattttattcggagaaaattttgttgtaggagagttattcgattttgatgaataaaaatggatatttaattgttttttaaattgagttttaataattttttttatttttattttttttttttttgatgtttttggtttttttttagtttttgagtatttttgggattttgtaaattaatataggttttagttggtttaggatttagtttttttgggttagttaagtagtttgtttatcgtttttttattttttattttttaaacgttggtgttgttatttattttttttattttggtgggtttaaaattttagaaaatttagttattgttattttagttggttataaagtgggagtttgtgtttattttattgtttttatttggaatttatatttttaatgtagagaatttataaataagataagaaataagaggtaaatattagttttgtattttttttttttggtattataatatttttgtatttttgttatgtatatttatattttgttagaaaaatgagataatatattatatagtttttattttttttttatttaaaatatatgaagagtattttttaatgttagtattttgtatttaaaaaaagattatataaaatgttattgtgtaaagtatagatatgtaaaa

SEQ ID NO: 29 - DNA, 6894 bp, Artificial Sequence
  Chemically treated genomic DNA (Homo sapiens)
gatagtttttattattagaatttagagtttaggagtatagttttatattggttttttttaaagtttggattataggattgttttttagaaaagtttgaaagtttttggtaaatagtatttagttatttagttttttttttttagtttttttttagaagagtaattcgagaaaatatttagtagcgtagaggaaagcggtatagtgttgttaatttatttttagtaagatttacggaattttaaaaatatagtttatgggttttaggacgtttgtagttttgttgtttaaaggttttttgtagtattaattttttttttaaattataagtggtgtttataggttttgttgttttttaaattttagagagatttttttttaaatgaaatttagagaatagaaagatttaaaattattttgatttggttagatatagaggtttaagattgttaagttattttgtgtttatttttttattaaagttattaaaatttttttattaaatgaatatttatggaagcgttaagattaattatttttggagttaaatagattttgatttaaattttagttgtgtaatataaagtttgtgggattttagatcggttttttggtttttgggttttaattttttaggggtgagttagattaggggtgagttagagagaataggatttttttgtattgttaataagaggattaaaatgagatttattatgtatagtataggatataagattagttggtatataataagaatttaatatataatagagttttttttttatttttggagtttttaaaaaatataaaaattatatatattttttttggttaaagatgatgattaatataaaaattttattttaggtttatgttttttggattttttaaagagtatttaatagagtgagttatatttggggttatatttgagttattcggggttatgtttttgtgttttgtgatgttgttaattcgatgatttgtgcgttttttttagttaaaaaataaaagtcggttttgtttttttttgtagttttttgaatagttataattattttaattgtttgttttgtttgttaagatttacgtttttaggtaaacgaattaattaagtttttttttgggtatagattataaagttatgaaaaatttgttttttttttttttttttatttattattttatttttgttttttggggagtattgtagagttagagttttttaagattttgtttattgtaagtttaaggtgatggagtttggttttcgggttaggagttaattttagaggttttaataatataagaaagaatgagatttaaagattattttgttaggtgggatggtttatatttgtaatttttagtgttttgggaagttaaagtgggaggatgttttgagtttaggagtttgagataggttttaatagggtatggatagaggaaagtagtatggaattgaagggtggatatttattgtttagtaaattataaattttggaaggaggtggaagggttttagatttgtgttgtttgtagtgaagaaattaagatataaaaaagtaaatgggagaggatagtagacggttttgaatggatgagagttagatatatggtaggtgtagatttttatttaagttttttaagttaaagatattgttgaaatatttggattattgacgttattttatagtaggtttttgtgaagtttaaatggagtgagttttgttttttttaattgttatttagtgtgttttataggtaatttttaagtaggaataataggagtatagtaatgtagtagaatttataaattttatttggtattgagaaaggttaagtcgagaggaaagtgattgttgttaattttattgtagtttgtgttggagtagggggtgttgtgtttggttttttgtatttgttgttattatttttgttatttgtgaaaggagtgtgatatggtggttataaggcgggttttgttgtattttttttagattgtggttttgggcgtttgtttaatttttttggggtagttttttttgggggttgagtgagtgaatgtatttggagaattaggtggtgtttatggtatgttgagtatttataaaggttattaattcgtgttattggttttttaattaagaatggggttatatattatttgtagtttttattattagtttggtagtatttataaacgtgtagtagtaatgtttgattggtggttttttgaagggattttatgggtatattgtgtatttgtttaaatttagggttttttatggatttataggattggtagttgtaggttagtaatgtatagtaattgaagttgggtttttaaattatttgtttttaaaaaaatattataattatttttaatatgtttttttttttttatgaattttattattaaatgtatttgaaattggaaatatatattaattttgattatatttaatggatttatgagatgggagtatttgttttagtagagtttttatatatggtttatgttggttataggtgttggtttttgtattaattaggattttgaagaggaaaataaatagtaggagatgggtagagatataaaagatttattataaggaattggtatatatagttatggggttgcgtagttttaagttttatatttagtaagttggagatttaggagagtagatgatgtgttttggtttgaaagttagtagacgtgagatttaagaggagtttatatttttgtgttagttcgaaggtaggaagagattagtgtttttattaggtagttaggtaggaggagttttttaggtcgtcgaggagttggtttgttatttttaggttttttgttgattggataaggtttttttttattttagagggtttttgttttatttagtaatttgtttaaatgtgtattttatttagaaatatttttagatatatttagaatattgttttattatatatttggtattttgaaatttagttaggttgaaatatgaatattaattattataggtttttttttattatcgatgtttttttagtaggtggggtatagtatataggattttttttatttttgaggtttttttagtaggtgggatatagtatataggttttttttgttattttcgaggtttttttagtaggtgggatatagtatataggttttttttgttatttttgaggtttttttagtaggtgggatatagtatataggtttttttttatttttgaggtttttttagtaggtgggatatagtatataggtttttttttttattttcgaggtttttttagtaggtgggatatagtatataggtttttttttttattttcgaggtttttttagtaggtgggatatagtatataggttttttcgggtttgggtaggaggtacgaaggtgatttatttttgtttgtttaggattgaggtggtttttgagatgtagaatttttggtttttaaattttgtttatgttttaggtaaataaggtaaattggttattttaggtagaatttttatagtagttacgttttgttaatttttttttttcgtatttatcggatttataaatttttttttgaatatttgatttttgatttaattttttttaaggtaattagtttttttttagataagtttttagagtgaggtcgtgatgggtttttcgtggattttagattataggttgtgtttttaaatttgttttttttaggaagtgtttttttcgttacgtggtgttggttttttttattggtgtattgtcgtagttcgtttttattttagagatatagaaaataagaagtttttagaaatgttagttttaggagttttatttttgaaatagaagtgttgacgtttattgtatagttatttttgggaatgatatattagtatttttatcgttattttataggttgtggggttaggtagtgatttagggagacgagtagtgagaaggaatggattaaatatttttcgagtttatcgagtttagttatcgttttttagttagagaaggtagttgtgggtttttttgtttttatatggatttttttttgttttatttttttttttattaagggtatcgttgttgtttatttgtttattttatatttacgtgtgtttacgagaaggatgggagggaaagtggggcggtaaagaataatttttgttattatttttcggtttaaaattttattaaagtttttttttataaagtgtttaagatgagggtttagtatattattttatttaaattataatattttatatatatttttataaatgtaaggggtataaaagtgttattttgttatatggatatatcgtgtagtggtgaagtttgggtttttagtgtatttgttattagaataatatacgtgttatttatagggtaattttttattattcgtttttttttattttttcgagtttttaatgtttattttatattttatatttacgtgtatgtattatttagtttttatatataagtgagaatatgtagtatttgattttttttttttgagttattttattttgataatggtttttatttttatttatgttgttgtaaaagatatgattttattttttttgatagttggggagtattttattgtgtatatgtattatattttttttatttatttatttattgatgaatattttagttgattttatatttttgttattgttattagtgttgtaataaatatatatgtgtaggttttttttaatatattgatttttttatattttatggagggaatagagtttttttaagcgagtgtggttggtttttattttttagtgtattttgtaattaatatttttgtatatttttttttaggtgattgggagattttaatttagatttttagtaagtgttataaggaagaaaagattttgaagaattaattaagtttttcgtgaagttaagtttaagtaatattttcgttttaattataagtaggagaaatgaagtatattattaattcgtatgaaaatattaataatatagtaagaaataatttcgattgttttcgtgtggttttgtcggaggagatattttttataatttttattgttggagttttggagaatttgatcgttttgttggttgtgtttaagaataagaatttttaggtatttatgtatttttttatttgtagtttggttatatttgatatgttgggtagtttatataagattttggaaaatattttgattatattgagaaatatgggttattttaagttacgtggtagttttgaaattatagtcgatgatattatcgattttttgtttgttttttttttgtttggttttatttttagtttgtttgtgattgttgcggatcgttatattattattttttacgtattgcggtattatagtatcgtgattatgcgtcgtattgtggtggtgtttacggttatttggacgttttgtacggggattggtattattatggtgatttttttttattatgtgtttatagtgattatttttacgtcgttgttttcgttgatgttggtttttattttgtgtttttatgtgtatatgtttttgttggttcgattttatattaggaagatttttattttttttagagttaatatgaaaggggttattatattgattattttgttcggggtttttattttttgttgggttttttttgtgttttatgtttttttgatgatattttgtttaagtaatttttattgcgtttgttatatgttttttttttaggtgaacggtatgttgattatgtgtaatgtcgttattgatttttttatatatgtttttcggagtttagagtttagggacgtatttaaaaagatgattttttgtagtaggtattggtagaatggttgatttttggttttagaatttatgggaataacgttgttaagtgttagaatagtgtaatattttaataaatgttagtgttttttattggttttttttttttaatggatgtaaggatgattttattagttagtgtttttaatagttaggttttatgtgaatagttttattgtaggggtaattttttaattttgtgattggatagataaaacgatgtagtaaaagaaggatagaatataaagtattaggtaggtataaaagtaattaaggtttttgttattatttttaatgattaaaaattgtaattatttttgtattaatttagtaaaatagtaataaaaatttaagggttttgggttaaggtaaagatttgtttttttgtggatatttaataagttagttttgaggtggtttttttaggtggaggttattgtagttaatttttagaagttaagtatttggatatgcgattttaggtagaagatgtagggtttttgtaagttaataataaattggaaggaatgtattgttgtagttgaatttgtttgttttttatagttatgtggaatttttatttttttttttttttttgttagtttgatgtattgatgttattttagttttagaaagtaggttgagtataaattataaatgttaaataacgagtttcgagtttttaatgataaatggattttttttgttagttttttttgtttatttagtattttattggttttaaaatttttttttgttatatttttttatgttttatgagtatatattttaaaggaagaaatgaaaatttaatttatttagtttttatgtgggaatatataaaggttagatgaaaattgttattatttgaagaagttgtaattaaattatgtgtgttataatgtagaagtataagaaaagagttttaatatgtattttaagaaataaagagagagagatagagatagatagagagagagagagagagagagagagagagtgt

SEQ ID NO: 30 - DNA, 6894 bp, Artificial Sequence
  Chemically treated genomic DNA (Homo sapiens)
atattttttttttttttttttttttttttttttgtttgtttttgtttttttttttttattttttaaaatatatgttggggttttttttttgtatttttatattgtaatatatatagtttggttatagtttttttaaatagtgataatttttatttggtttttatgtatttttatatgggaattaaatggattaaatttttatttttttttttgaaatgtatgtttataaagtatgaggaaatgtaataggaaagggttttaaggttagtgggatattgagtgagtaaagaagattaatagagaaggtttatttattattggaaattcgaagttcgttatttgatatttatagtttatatttagtttattttttgaaattgaggtggtattaatatattagattaatagggagaaagaggagggtggagattttatatggttgtgggagatagataaatttagttgtagtaatgtattttttttaatttattattggtttatagagattttatattttttgtttggagtcgtatgtttaggtatttaatttttggaaattggttgtaatggtttttatttggaaaggttattttagaattggtttgttagatgtttataggaaagtaagtttttgttttagtttaaagtttttgaatttttattgttgttttattagattggtgtaaaagtaattgtaatttttggttattgaaagtaatggtaaaaattttaattatttttgtatttatttaatattttgtattttattttttttttattatatcgttttatttgtttagttataaagttaagaggttgtttttataataagattgtttatatagaatttagttattagaaatattagttggtgggattatttttgtatttattagggaaggaaggttagtgaggagtattggtatttgttggaatgttatattattttggtatttggtaacgttatttttatggattttaaaattagggattagttattttattagtatttgttgtagaagattatttttttgaatgcgtttttgagttttgggtttcggaaggtatatatgaaggggttaatgacggtattgtatatgattaatatgtcgtttatttggaagagagatatgtagtaggcgtagtaggggttatttgggtagaatgttattaagaggatatgaagtataaagggggtttagtagaagatgaagatttcgagtaggatggttagtgtgatggttttttttatgttggttttggggagggtggagatttttttggtgtgggatcgagttagtaggaatatgtgtatatagaggtataggatgaagattagtattagcgggaatagcgacgtgaaggtgattattgtgggtatatgatgggagaagattattatggtgatgttagttttcgtgtagaacgtttagatgatcgtaagtattattatagtgcggcgtatggttacgatgttgtggtatcgtagtgcgtggaagatggtgatgtagcggttcgtagtaattatagataggttgaagatggagttaagtagggagaggataaatagggagtcgatgatgttatcggttgtggttttaaaattgttacgtggtttgagatagtttatgttttttaatatgattaggatattttttaagattttatataggttgtttagtatattagatatggttaagttatagatgaaaaagtatatgggtgtttggagatttttatttttgaatatagttagtaggacgattagattttttaaaattttaataatggaaattgtgaaaaatatttttttcggtaaaattatacgaggatagtcggaattattttttgttgtgttgttgatgtttttatacgagttgataatgtgttttattttttttgtttgtggttaaggcggggatgttatttggatttgattttacggaaaatttgattgattttttaggatttttttttttttgtagtatttgttggagatttaagttaaaattttttaattatttaaaagggagtatatagaaatattagttgtaaagtatattagaaaataaaaattagttatattcgtttaaagaaattttattttttttataaaatataaagaaattagtatattagaaggagtttgtatatgtatgtttattgtagtattagtgataatagtaaagatatggaattaattaaagtgtttattaatgggtgaatggataaagaaaatgtggtatatatatataatggagtattttttagttattaaaaagaataaggttatgttttttgtagtaatatggatggaagtggaggttattattaaagtgaaataatttagaaagaggaagttaaatattatatgtttttatttatatgtgggagttaaataatgtatatacgtggatatagagtgtggaatggatattggagattcggaagggtgggagggggcgggtgatgagaaattattttatgggtaatacgtatgttattttgatgatagatatattaaaagtttaggttttattattatacggtatatttatgtaataaaatggtatttttgtattttttatatttataaaaatatatataaagtgttgtaatttaggtaaaataatatattgggtttttattttaagtattttgtgagaaaaagttttagtggaattttgagtcgagagatgatagtaaagattattttttgtcgttttatttttttttttatttttttcgtgaatatacgtgagtgtgggatgaatagatgaatagtagcggtgtttttgatgaaaaaagaggtaaagtaaggaaaggtttatgtgggagtaggagagtttatagttgttttttttgattgggaggcggtggttgggttcggtggattcgggagatgtttagtttatttttttttattgttcgtttttttgggttattgtttgattttatagtttgtgggataacggtaaaggtgttgatgtattatttttaaagatgattatataatgagcgttagtatttttgttttaaaggtggagtttttgggattggtatttttggagattttttattttttgtgtttttggggtgaaggcggattgcggtagtgtattagtggggaaagttagtattacgtggcgaggaagatattttttagggaggataaatttgggagtatagtttatgatttgaagtttacggggagtttattacggttttattttagggatttgtttggaaaggaattaattattttggaaaggattgggttagaggttaagtgtttagaaggaggtttgtgggttcggtggatgcggaaggaaggggttgatagggcgtagttgttgtgagggttttgtttggaatggttaatttattttgtttgtttgaaatatggatagggtttaaaagttagaagttttgtattttaggaattattttagttttgggtagatagggatgagttattttcgtgttttttgtttaggttcggggaagtttgtgtgttgtgttttatttgttggggaagtttcggggatgggaggggaagtttgtgtgttgtgttttatttgttggggaagtttcggggatgggaggggaagtttgtgtgttgtgttttatttgttggggaagttttagggatgggagggggtttgtgtgttgtgttttatttgttgggaaagttttagggatggtaggggaagtttgtgtgttgtgttttatttgttggggaagtttcggggatggtaggggaagtttgtgtgttgtgttttatttgttggggaagttttagggatgggaggggttttgtgtgttgtgttttatttgttggggaagtatcggtgatgggagggggtttgtggtggttggtgtttatgttttagtttgattgagttttagggtgttaggtatgtggtgagatagtgttttaggtgtgtttgagggtgtttttgggtgagatgtatatttgaataggttattgagtaaaatagaggttttttgggatgggggagggttttgtttaattagtagaaagtttgaggataatagattagtttttcgacgatttggggggttttttttgtttgattgtttgatggagatattggtttttttttgttttcggattagtatagaagtgtgagttttttttaggttttacgtttgttggtttttagattagaatatattatttatttttttgggtttttagtttgttgagtgtagagtttgggattgcgtagttttataattgtgtgtgttaattttttatagtaaattttttatgtttttatttattttttgttgtttatttttttttttagaattttggttaatataggggttaatatttgtggttagtatgggttatgtatggagattttgttgggatagatatttttattttatgagtttattaaatgtaattagaattagtatatatttttaattttagatgtatttgatggtaaaatttataaaaaaaaaaagatatgttgaaagtggttgtaatatttttttagaaataggtggtttgggagtttagttttagttgttgtgtattgttgatttgtagttgttaattttataaatttatggggagttttgaatttggatagatatatagtgtgtttatggggtttttttaaaaggttattaattaagtattgttattgtacgtttgtggatgttgttaagttggtggtgggggttgtaggtggtgtgtggttttatttttggttgaagggttagtgatacgaattggtggtttttatgagtgtttagtatgttatgggtattatttaattttttagatgtatttatttatttaatttttagaggaagttattttagaaaggttgggtaaacgtttaaagttatagtttggagaggatatagtagagttcgttttgtgattattatgttatattttttttataagtggtaagggtaataataatagatgtaagagattagatatagtattttttattttaatataaattgtaataaaattgatagtagttatttttttttcgatttggttttttttagtgttaagtaggatttgtaaattttgttgtattgttatgtttttgttgtttttgtttagagattgtttgtagaatatattaaatgataattagaagaagtaaaatttattttatttaaattttataaggatttgttgtgaggtggcgttaatgatttaaatattttaataatgtttttggtttaaagaatttggataggggtttgtatttgttatatgtttggtttttatttatttaaagtcgtttgttgtttttttttatttgtttttttgtgttttgatttttttattgtaaataatataggtttagagtttttttatttttttttagggtttgtggtttgttgggtaataaatgtttattttttaattttatgttgtttttttttgtttatattttattgaaatttgttttaagtttttgggtttaaggtatttttttattttagttttttaaggtattggggattatagatatgaattattttatttggtagagtgatttttaaattttatttttttttatgttattggaatttttggagttaatttttggttcgaagattaagttttattattttgagtttgtagtaaataaggttttagaaggttttaattttgtagtgttttttaggaggtagagatggggtggtggatgagaaaggagaaaagagataagttttttatagttttataatttgtatttagaaagaaatttggttgattcgtttgtttgaaggcgtaggttttggtaggtagagtagataattggggtagttataattgtttaagggattgtaaggaaaagtaaaatcgatttttgttttttggttgggaggggcgtataaattatcgagttaatagtattatagggtataagaatatggtttcggataatttaaatgtggttttaaatgtggtttattttgttagatgttttttggaaagtttagggagtatgggtttaaagtgagatttttatattgattattatttttgattaaaaaaaatatatatagtttttatattttttaaaggttttaagggtaaggagaaggttttattatgtgttaaatttttgttatgtgttagttggttttgtgttttgtgttgtgtatggtgggttttattttaatttttttgttgataatataagggagttttattttttttgatttatttttgatttgatttatttttgaggagttgaggtttagagattaagagatcggtttaaagttttataggttttgtgttgtatagttgggatttaaattaagatttgtttggttttaaaaatgattaattttagcgtttttatgaatatttatttgataaggaagttttaatggttttagtaaaaaaatgaatataaaataatttaataattttaaatttttgtatttgattaaattaggatggttttaaatttttttgttttttaaattttatttagagaaaaatttttttgaaatttagagaatagtaagatttgtagatattatttgtggtttaggaagggagttaatgttatagaaagtttttgagtagtagggttgtaggcgttttggggtttatgggttgtgtttttggggtttcgtggattttgttgaagataagttagtaatattgtgtcgtttttttttgcgttgttgggtgttttttcggattgtttttttggagaagagttggggaaggaggattgagtggttgagtattgtttattaggggtttttaggtttttttagagggtagttttgtaatttaggttttagagagagttagtgtaggattgtgtttttgagttttgggttttggtggtgggagttgtt

SEQ ID NO: 31 - DNA, 5659 bp, Artificial Sequence
  Chemically treated genomic DNA (Homo sapiens)
taatgattatttttagtgtttagttttttttttaagtaaaatatataattaatgttaggtaagttttttttaatggttttttagagagttaaacgtttttatgttgagttggaaatattgatgtttttttttttttgagatagagttttattttgttgtttaggttggagtatagtagtacgatttcggtttattataatttttgtttttcgggtttaagtgatttttttattttagttttttaagtagttgggattataggtatgtattattatgtttagttaatttttgtagttttagtagagatagggttttattatgttggttgggttggttttaatttttgattttaggtgatttgtttattttagttttttaaagtgttgggattataggtacggtggtgttcgattgatttttttttttttttttttttttttttttttttgagacggagtttcgttttgtcgtttaggttggagtgtagtggtgtaattttagtttattgtaagtttttttttttaggtttatgttatttttttgttttagttttttgagtagttgagattataggtattcgttattatatttagttaatttttttgtatttttagtagagacggggttttatcgtgttagttaggatggttttaattttttgatttcgtgattcgtatattttcgttttttaaagtgttgggattataggcgtgagttattacgtttggttcgattttttttttaaatgttggtttttttggttttaatattttgttattattttgataattaagaaatatgtttttgttttaaataataaagattaagagattatttgttttaggtaaatagaaaaatttttattattttttttaatgtgtttagtaaaattataaaggtaattatgttttggggaattaattattttatatagtatgaagtaaataaagttattttgtttaataaattaaataatattagttagttgaggggtataaagaatgaattaattttttttttttgttttattaattttttaagttttatttttaagtatttttgatttaaagataagattgtttttttttgattatttaatttttattatgtttattattaaagttaaagtagatgtaataagttttaatattattgaatttaatattttaattaatagaaatatagattatatttaggttgggtgtagtggtttacgtttgtaattttagtattttgggaggtagaagtgggtggattttttaggtttaggagtttgagattagtttgggtaatatagtaaaatttcgtttttattaaaaattgaaaaaaattagttgggtatggtggtacgtgtttgtagttttagttacgagaaaggttgaggtgggaggattatttgagtttagggaggttaagtttgtagtgagtcgtgatcgtattattgtattttagtttgggtaatagaatgattttgttttaaaggaaaaaaaagaaagaaagaaaagaaatgtagattacgttttagtagtttgggtgaaagttatgaaaataatttacgggaaaaaataattagtttgtgaaataatttttgtaatataattaagagttagtgagaggaggtgatagttaattaagtatgtgaaatgaaatgttttgtagttagttatatttttaggagggttatttttagtttatgtagtttttataagttgttttaatgttataaaaatattatttttatcgagtttatattatttttttggagattgaagagatatttaaattaaatttttgagtttttttttttagtttatttaagttaatttataaaaatataggggaaagaatatagttttaaaaaattaaaacggaaaataaaaaatgtagaaattatagtatgaagttaagagtttaaataagtttataatattaaagatattttatgagtaaaataagaaaattaagtagtaattatttagtttattgattatggttttttttggaatgtagtgaaagatttagttttgttttttgtatttattataggtgttaagagtttaaggagggtttaagattaagggaagttaaatattgttagggaaagtaaatatatgtttaaattattatttttaaataagtttattatttataatttaaaattattaatttttatgtggtttttgtaagtattttttaattttatttttaaataaagagaaattattacggaagtattttttttagaagataatttataattattatttaattcgatttttttttttttttttttttggaaattttggtatatggatttgttattattgttaagaattatttagggttaggcgcggtggtttacgtttgtaattttagaagtttgggaggtcgaggtaggtggattatttgaggttaggagtttaagattagtttggttaatatggtgaaatttcgtttttattaaaaatataaaaattagtcgggtatggtggcgggtatttgtaattttagttatttgggaggttgaggtaggagaattatttgaatacgggaggcggaggttgtagtgagttaagatggtattattgtattttattcgtggtgatagagcgagatttcgttttaaaaaaaaaaaaaaaaaaaagagagacggagttttagttttgttgtttaggatggtatgtagtaatacgatttttgtttacggtaatttttgttttttgggtttaagtgatttttttgttttagttttttgagtagttgggattataggtatatattattgtgtttagttattttttgtatttttagtagagacggggttttatcgtgttggttaggttggtttcgaatttttgattttaggtgatttatttgtttaggttttttaaaatgttgggattataggtgtggtgagttattgcgtttagtttttttttttattttggggaatattttattttgtttatggagtagttgttgttttattattttatttttttaataaatttgtttatattttgtattgcgattcgttttgaattttttttgtatgagatttaagaatttttttttgtggtttggattgggattttttttttgtaataaatgtattggttgataggagaataaagaaaaaaaaagaggaaaaattagagtaatttttttatataattatattatatgatcgttttgttaattatgataatagttaataaaataatttttttatgtttaatttttagtttatgtttgtatgttttaaaatgttttttatagttggtttgtttaattatttaatgaaggattaaatattgtagttggttgttatgtatttagttttttaattttgatttttagattatttttagtttattttattatattcgttttaagttttttgagttagttaattttaatttgttatgtattttataaaatgttttttttttttttatagtcgattgtttttttgtttttggagtttttttttttattttttaaggttattttgagtatatttttttgtttcgtgaaatttatttttttttttttttttttttttttgagtttaattagttgttatcgtaggtttttgtttttttttatagtgtggttagaattcggttttgtttgttagtagagggtagggtcgttgtttttttttttttgtagtttttaagtttagtatatgtttggtatttagtggtagtataataaggaatttgatgaatattttttttttttgtttttcgttttttttttatagtttgttagttatggttaggaagagtaagattcggaatgggtttggtgtgtttcgcgggaaggtcgtgattttggaagatgttttttagtttagttcggattttttttttttagttttagagattttttttattttttgtgtatatatatatattaagatttaggaagtggtttttgaggtaggattttaagagtttaaggagtggggtcgaggttggaggtgtgggggtgtgacggtcggttttatttttcggtttgtttagattagttttttttggggattatttttggtatataagggagggaggtagtttgatttttttagttcgtttttagtttttatttggttttgttttttgggataagacggggaaatttagaggatgtaagttttttttgttttcgtgtttttttttaagttttcgttattatagacggatgtaggagttgtttgggaggttggaagtatagattttgttaatttttttttagagggcgggattcgacgcggacgtgttttgattgattgggtagcgtggtttcggggaagggtttttttttttttttttagattaggatttttggaaaatggagaagttgtgttaatagaggggggttagaaatttttattttagaatgttgtagaatgttgggagatatttaggatgtgagttagggattttttggaagtgtttgttttggttttattcgattttaggtagtttttagttgtttgtatagtcggatggggagggggtttgtatagagttggagttagaggagagagttggtttattttttacggtaggatggggaaattttatagattatattgttattcggttttagtttttcgtttcggcgtttagagggtaatttttatttatttcgttcgtttttttgaattagagtgatttaggttgcgtttcgtttcgtttttttatttcgagttggtacggaggtatagcgttagaggggggttttaggcgtttcgaggttttgtttttgcggttttttttttgcgggggtgggcgttttttttcgggtaggggttacgtggttttggtcgggcggggggttcggtttatttcgcgtcgggtttagtgatttaggtcgtagttgttatcgcgttatatgagggaggtcggcggttattcggcgggggaggggatcgtggttggagttcggggcggggtcgcgcggtaggcggggcgggagtcggggggcgtagttagagagtttcggagtcgcggcgggagaggaacgcgtagttagttttgggaagtttaggtgaggtcgcggggattcggcggatttcggcgcgggttgggagagattattcgtagtttttttttttagggttcgttttaggttcgcggagattcgttcggcgttttttagtcgttttggagtaattttgtttcgaagttttttgggttcgggtagggtgtggcgggggtgttggttgtattttttttttttttggtgggcggggaggttagagtttaggggaaaggggttggggcgggggtcggggttgggttgaagatcgtttttttaggttgggtgttgggtggggaaagggtgtttgacgttcggagattggcgggtcgagggtcggcgttaggtttaagtttttgtcggcgtttttggatttgttttgggttttagaggcggcggggcggggttcgggtttcgcggtcgtcgtttttattttttttttgcgggtaaagagggggttgggagacgtggattcgatcgcgggttttcgggtgggaggggtcgggaatcggggtcgtgaagggaagttttcgagggtcggtcgggagttcggaaatcgaggttttttttcggttagttttaattttttcgtttttttttttgttttagg

SEQ ID NO: 32 - DNA, 5659 bp, Artificial Sequence
  Chemically treated genomic DNA (Homo sapiens)
tttggggtagaggggagggcggggggattaaaattggtcgaagggggatttcggttttcgggttttcggtcggttttcgagggtttttttttacggtttcgattttcggttttttttattcggaaattcgcggtcggatttacgttttttagttttttttttattcgtaggagaggggtgggggcgacggtcgcgaagttcggatttcgtttcgtcgtttttggggtttaggatagatttaagggcgtcggtaggggtttgagtttgacgtcgattttcggttcgttagttttcgggcgttaaatattttttttttatttaatatttagtttggagaaacggtttttagtttaatttcgattttcgttttagttttttttttttgggttttgattttttcgtttattaaaaaaaaaaaaagtgtagttagtattttcgttatattttgttcgggtttagggaatttcgaagtaaagttgttttagggcggttggagagcgtcggacgagttttcgcgggtttggggcgagttttggaggaagggattgcgggtggttttttttagttcgcgtcgaagttcgtcgggttttcgcggttttatttgggttttttaaggttggttgcgcgtttttttttcgtcgcggtttcggggttttttagttgcgtttttcggttttcgtttcgtttgtcgcgcggtttcgtttcgggttttagttacggttttttttttcgtcgagtggtcgtcggttttttttatgtgacgcggtaatagttgcggtttgagttattgggttcggcgcggggtgggtcgagtttttcgttcggttagggttacgtggtttttattcggaagaaggcgtttattttcgtaaagggaaagtcgtaagggtaagatttcggggcgtttggggtttttttttggcgttatattttcgtgttaattcggggtaggagagcggggcggagcgtagtttgggttattttggtttagagaagcggacgaggtgggtgagagttattttttgagcgtcggggcggagagttgaggtcgggtgataatgtggtttgtgaggtttttttattttatcgtaggggatgagttagtttttttttttggttttaattttgtgtaagttttttttttattcgattgtgtagatagttggggattgtttggggtcgggtggggttagaataaatatttttagaaagtttttggtttatattttgggtgttttttaatattttatagtattttagagtggggatttttggtttttttttattagtatagtttttttattttttagggattttagtttgagaaaaggggaggaagttttttttcgaagttacgttatttagttaattaagatacgttcgcgtcgggtttcgttttttgggggaggattgataaggtttgtgtttttagttttttagatagtttttgtattcgtttgtgatagcgagggtttgggggaagatacgaaggtaggagaggtttatattttttggattttttcgttttattttagaagataaagttaggtgagggttggaagcgggttagggggattaagttgttttttttttttgtgtgttaggggtggtttttagaaggagttgatttgaataggtcggagagtaggatcggtcgttatatttttatatttttagtttcggttttattttttgggtttttaaggttttgttttaagaattattttttgagttttagtgtatgtgtgtatataaagaatgaaagaagtttttagagttaaaggaaggagattcgggttgggttgagaagtattttttaggattacggttttttcgcgggatatattaagtttatttcggattttgttttttttgattatggttggtaggttgtggaggaggagcggagagtagaagaaaggagtatttattaggttttttattgtgttgttattagatgttaggtatgtgttaggtttgggggttgtaaggagaggaagatagcggttttgttttttgttagtaggtagaatcgagttttggttatattgtgaagaaaggtagaagtttgcggtggtagttggttaagtttagagggagggaaagggagaggagaatggattttacggagtagaaggatgtgtttaaggtgattttggagaataaaggggagagttttagggatagagaagtagtcgattgtggaaaaaaaaggagtattttgtaaagtatatggtaggttggggttggttggtttaaagggtttgggacggatgtggtgagatgggttgaaggtggtttgaagattaagattgagagattagatatataataattaattgtaatgtttggttttttattgaatggttgaataaattagttgtgaaagatattttgggatatatagatatggattgagaattagatataagaaaattattttgttaattgttattatggttaataaaacggttatataatatgattatgtagagaagttattttagttttttttttttttttttttttatttttttattagttaatgtatttgttataggaaaggggttttaatttagattataagagagggtttttggattttatgtaagaaagatttagggcgagtcgtagtgtaaagtataagtaagtttattaagaaagtaaagtggtgaaataatagttgttttatagatagagtaggatgttttttaaagtaagaggaggggttaggcgtagtggtttattatatttgtaattttagtattttgggaggtttaggtaggtggattatttgaggttaggagttcgagattagtttggttaatacggtgaaatttcgtttttattaaaaatataaaaagtagttgggtataatgatgtgtgtttgtagttttagttatttaggaggttgaggtaggagaattatttgaatttaggaggtagaggttgtcgtgagtagaaatcgtgttgttgtatgttattttgggtaataagattgaaatttcgttttttttttttttttttttttttttgagacggagtttcgttttgttattacgggtggagtgtagtggtgttattttggtttattgtaattttcgtttttcgtgtttaagtgatttttttgttttagttttttaagtagttgggattataggtgttcgttattatgttcggttaatttttgtatttttagtagagacggggttttattatgttggttaggttggttttgaatttttgattttaggtgatttatttgtttcggttttttaaatttttaggattataggcgtgagttatcgcgtttggttttaaataatttttaataatagtagtaagtttatgtattaaggtttttaagaaagaggagggaagagaatcgagttgggtagtagttataggttgttttttgaaaaaggtgttttcgtgatagtttttttttgtttggagatagagttaagaaatatttgtagagattatatgagaattaatgattttggattgtgaatggtagatttgtttggaggtgatgatttagatatgtgtttgttttttttggtagtgtttggttttttttgattttaagttttttttaggtttttgatatttgtgataaatgtaggaggtagggttgaattttttattgtattttagaggaggttataattagtggattggatggttgttgtttagtttttttattttgtttatagggtgtttttgatgttataggtttatttgaatttttagttttatattatagtttttgtattttttgtttttcgttttgattttttaaaattatgtttttttttttatgtttttataggttaatttggataagttgaaggaaagagtttaaagatttggtttgaatgtttttttaatttttagaaaggtaatgtaggttcgatggaagtaatgtttttgtgatattagagtagtttatgggaattatataggttggaaatgatttttttgagaatgtagttggttataaagtattttattttatatatttgattgattgttatttttttttattgatttttgattatgttataggaattattttataagttgattgttttttttcgtggattgtttttatagtttttatttaggttgttagagcgtggtttatattttttttttttttttttttttttttttttgagataaggttattttgttgtttaggttggagtgtagtggtgcgattacggtttattgtaggtttgatttttttgggtttaggtgatttttttattttagtttttttcgtagttaaaattataggtacgtgttattatgtttagttaattttttttaatttttggtagagacgggattttgttatgttatttaagttggttttaaatttttgggtttaagggatttatttatttttgttttttagagtgttgggattataggcgtgagttattgtatttagtttgagtatggtttatatttttgttggttaagatgttaaatttagtgatgttaaaatttattatatttattttaattttgataataggtataatgggaattaaataattaggagaagatagttttgtttttaggttagaagtatttagaaataaaatttggaggattggtggaataaaaaaaaaaagttaatttattttttatgttttttagttaattgatattatttagtttattaagtaagatgattttgtttattttatgttatgtggggtgattggttttttagggtatagttgtttttgtagttttgttaggtatattggagaaaatgataaggatttttttatttgtttagagtaggtggttttttaatttttgttgtttagaataagaatatgttttttggttgttaaagtggtggtagggtattaaaattagaaaaattagtatttaagaaaaaaatcgggttaggcgtggtggtttacgtttgtaattttagtattttgggaggcggagatgtgcggattacgaggttaggagattgagattattttggttaatacggtgaaatttcgtttttattaaaaatataaaaaaattagttgggtgtggtggcgggtgtttgtagttttagttatttaggaggttgaggtaggagaatggtatgaatttgggagggggagtttgtagtgagttgagattgtattattgtattttagtttgggcgatagagcgagatttcgttttaagaaaaaaaaaaaaaagaaagaaagaaaaaaattagtcgagtattatcgtgtttgtaattttagtattttgggaggttgaggtgggtagattatttgaggttaggagttgagattagtttagttaatatggtgaaattttgtttttattaaaattataaaaattagttgggtatggtggtatatgtttgtaattttagttatttggggggttgaggtgggagaattatttgaattcggaaggtagaggttgtagtgagtcgagatcgtgttattatattttagtttgggtaatagagtgagattttgttttaaaaaaagaaaaatattagtatttttaatttagtatgaaagcgtttagttttttagaaagttattggaagaaatttatttgatattggttatatattttgtttgggaaaaaaattaaatattaaaagtaattatta

SEQ ID NO: 33 - DNA, 6112 bp, Artificial Sequence
  Chemically treated genomic DNA (Homo sapiens)
atttataggggtagggttgtagggtatttgtaggagttgggagtttgggggatttggtggagttgggagtaattgttgttaattttttttaagagtttgtttttgaaaaaggtaatggaagggaaggaggtattgaaatggtaggtggtaggttaggcgtggtggtttacgtttgtaattttagtattttgggaggttgaggtaggcgaattaggagattaggagatggagattattttggttaatatagtgaaattttgtttttattaaaaatataaaaaattagttaggcgtggtggtgggtgtttggagttttagttattcgggagggaggttgaggtaggggaatcgtttgaatataggaggcggagtttgtagtgagtcgagattacgttattgtattttagtttgggtaatagagtaagattttgttttaaaaataaataaataaaaaatataaaaagtagttgggcgtggtagtaaacgtttgtagttttagttatttaagggattgaggtgggaggattatttgagtttgggatgtcgaggttgtagtgagttgtgttaatattattggattttagtttggttaatagagtgagtttaaaaatatatatttatatttttatatatttatatattaaaaaatataaaaaagtggcgagtgatagttgaggagattattgtagtgggaattttaggagggggtgaggaggggttcgttggtataggggaaggggtgttatagagaaagattttggtttttttggggttttggagtggtagagagagtttaggatgtttgtaaatgtatagaaattagagggtgggaatttttttgggaggtttgtttttttttatgaaggagaagatagagtaattttgttgatagggagggtagagaaggagaggtgaggggtttgagggaagaggtttggtatagaggttggggagagggaaatgagagcgtttaggagtttttggaagatgatttgggttagtagttggggttgttattagggtagttgttgggagggtagggtatttggaggttttaaatttgtattattatagatttttttttagtagggtttaattttttggatggagaggtttgggaggtgtagtagggaagttggggatgacgttgatttggggtttataatatttttttttagtaggtttaggggtttgtagttgttggtaacgggttgattttatttttgggtgaataggtgaagtttttcgggttgtttcgggaagataaaggttgggttttttggtttcggtttttgggattttgagatatagatgttttttttgggaaaggttcgttaatatattaagtaaggtttggtaagggaggaagagtttagggtttttttttgatatttgggggaaagtgttggggaagatttgggtagtatttaaaggttttagtgaatttaaagatagaaggaagatagaaggaggttggattggtaaagggaattttatagtagatattttaggtttttatatttagtagatttggagttttggaagttgaggttgtgaattttttttcggttagttggggtgtttagttttgttttgttcggtttatatggtagggatttattttgtaggttttgtgggttgggtgttggttgggtttggttagttttatttgtaatttagggggaggagtaggggagatataggatgtttttaattttttgattttttgaagtttttttggtattagttcgggtttttattatagtttttagtggaagagtttggaaggggggtagttgttttttgtttagttttttcggttttttagtaattttattttttatgttattacgtttttgcgttaagtttttttttttttaaatatttaatgtgattttttttggttagttggagtttaattgagatatttattttttagaagtttagttttgggaagtggagttaatttttggaagtttgtagattttttttagtgggttgttagattttagtatgagtatgaggtttattatggtttattgggttttaggggttagaagtgtttatgggtgttttaagtgggtgttttattatataggttttatggggggtagttagattatagtagtagatagagttgggtcgggtttatgtaggtttaaagaagtagttagtggttatttaaggtagtggtatttttgtagttttttggttggtgtttgagattagttatattttttataataattagagttatgtttatattttttattattatttagttttttttttgttaaaacgtggagtattgttttttagttttggagtttaggggtagtagataatttgagttagttggagtaggtggggtcgtttttggttggaacggttatggaaaattttaattaaagatagtatttgggagaatatttatgaaaatgtgaaagtttatatttttgatttagttgttttatagatatgatttgtgtaaaataacgtaagtgagaatatttgttatagtagtttgtaatggttaaatatagtaaaaaattttaattatttagtaatggtgattagataaattgtgatttttttatataaggaatgttatgtagttattaaaaagaatgaggtagttttatatgtgttgatgtaggatgagttataagatatatatagttaatataaaagaagagtttagaatagtgtatatgatagcgtttgtattaaatataataaatatatttgtttatttgtacgtacggttgaatttggaaggatatataagagattgttattgttttgagattgggaggtttaggggataggaacgggagggagattttttattgtgtatttgtttgaattttttgaattttgtattatgtgtatattttataatttaataaatatttatgtttttaaaagaaaataaaaaagtatttagaaataaataggttagacgtggtggtttatttttgggaggttgaggagggaggattgatatagttggggatgttaaggttgtagtgagttatgattttgttattgtattttagtttgggtgatagagtgagattttgttttaaaaaaaagaaattgggatgatatagtagtgtttttatttatattttacgtttttattgttagttatgcgatttttggataagttaatttatttttatgttttagtttttgtaaaatagtggtaattttttggaaaggttattttgaagagtaagttaattaatatgtaaagagttggaagagcgtttggtattgaattagtattatgaagtgttagatattgttattttgttgttttagattaattttaaagtaacgttatttgagttatgtcggttttttttgttgttgtttttatttaaatattttatttatttaataaataattttatttttttttttttttttttttttgagatggggtttcgtttttgttttttaggttggagtttaatgacgcgatttcggtttattgtaattttcgttttttgggtttaagcgatttttttattttagtttttcgagtagttgggattttaggcgagcgttattatgttcgttaattattttttgtgtggagatagggtcgtattatattatttaggtcggttttaagtttttggatttaagcgatttttttgtattagttttttaaagtattgggattataggtatgagttatcgtattcggttttaataaatgtttttttttttgagacggagtttcgttttgtcgtttaggttggagtgtagtgggcgatttcggtttattgtaattttcgttttttcggtttatgcgtttcggttttttaaaatgttgggattgcggatttgagttatcgcgttcggtttgaggtgatttttaataagtatagtcgtagttgtagatattttggttttgtaggaataatgaggtatggatggatttatagttggatttatggatgggatggattttcggtaggttttggacggagggaaatgttttggtttgttaagttcggtatcgagtgagatttatttataaagttaatcgtggaagttattggcggtttttttcgttttgtcgtcggggaattttgtcggtggttttcgatttgttttcgggttatttggtgatattgatttcgtagttattattttaattggcgtattcgatttaaataataattagggaatttgtgggcggttaaaggttcggttttgcggtcggtttttttaggtttttttttttgttttgtgaggttagaaagttattttttcgaggtcgttttttatgtcgagaaatatttttcgtttgaggttttgtggggtaggggaggttcgtgtattttttatagaaaatttcgtatagattcgcgattgtttttattaatagtttttaggagattgtttgtagtcggggggttgtcggttttatgttcgcgggtaagtagggataagttgtgtttttaaaagggttaacgggaatttcgcggtttttgaattttcggtgttggcggatttttcgttttagggttattaggagtcgcggcgtgagtgcgtgtcgggatcgagcgcggggtttttgaggaattttaaggttgtttaagtttacggatttagttatattggcgaatcggagatcgttcgattttattattttcgcgttttttttatagtcggcgttaaaaacgttagttttacgacgtaggtcgggattcgcgcgtttacggtttaattagcgcggattttgtataaagcgagtttcgtttttacggcgtcgttgttagtttttttttttttcgtggtcgtttcggttcgtttatttttcgtttcgcgtcgtttacggttagaggttcgcgattggtttatggggacggtcgcgagttttggttggtcggcgcggagttacgagggcgtcgtcgtcgtttttttataggcgattattgggtaggtttagtttttcgttttagtttcgagttttcgttggttttcgggtgtacgtgtttcgggatttttagtattcgcggtcgttatcgtcgtcgtttggttttttttggatttatttgcgttatttgttcgttttatatttcgtcgttattatggtgaagttcgcgaaggtaaacggttttgagcgcgagcgtagacgtgtaggtttgtttttcgaggggcgagcgcggcgtcgcggggaggagggtttgcgcgtagtttcgggcgcgttttagggcgttatgttgcgggaagtttcgcgcgattagtggggaggtttcgcggtttttggttatttggtggcgaggtgaagagtttttgtaggtgttgggggcggcgaacgcggcgggaaagatagagttattgagcgcggggagggggcgttgggtttcggggtggagagatgagattaaatttttgcgacgcgtacgagttgggattcgatttttgacgtacgtgttcgggagcgcggtttgttacgtgggtcgcgtcgcgtgggttttggaatttttagagggatcgggtgttttgggtcgggaaatggcggtatcggttttagtcggagtttcggttgcgttcggatgttttcgtttcggtttggtaagtcgatacgtggtgggtttcggaaggtggttttgtcgcgtgttttttgcgttgtgtttcgggtacgtggtggtttattaggtatttttacgtggtcgcgtcgtttttttaaggggcggggttgtttcgttgggaaaggtataagttttatgagaaaattaaggtagttatttttttaagtgttttaatgatttttatcgttaatttggatttagatgagggtggtagaataaagtatcgggatttgtagtattaaaatacggttgtgtttaattaaggtaacgggaggagaaattatttttttaggttgattttttattttagggtaggttttttgttggtaaagtttgggaggaaaaatgtgggcggttgagagtagttttttttgtattgttattaggagtagtttttatgttagttgtggtgtttggtattatgagaaatggatttgaggacggagatgatggcgtatgaatattaatggtaaaatatggggattttttagtagatt

SEQ ID NO: 34 - DNA, 6112 bp, Artificial Sequence
  Chemically treated genomic DNA (Homo sapiens)
ggtttattagaggatttttatattttgttattagtgtttatacgttattattttcgtttttagatttattttttatagtgttaaatattataattaatatagaaattatttttgatggtaatgtaagagggattatttttaatcgtttatatttttttttttaggttttattaatagaaaatttgttttaaggtaaaaagttaatttgaggaaatgattttttttttcgttattttagttaagtataatcgtgttttaatattataaatttcggtattttattttattatttttatttgaatttaaattaacggtgaagattattaaggtatttaaaaaaatgattattttgatttttttatgaagtttatgttttttttagcgagataatttcgttttttaaagaggcggcgcggttacgtgggggtatttggtaggttattacgtgttcgaaatatagcgtaaaaggtacgcggtagagttatttttcggggtttattacgtgtcggtttgttaggtcggggcggagatattcgagcgtagtcgggatttcgattagggtcgatatcgttatttttcggtttaaggtattcggtttttttggagattttaggatttacgcggcgcggtttacgtggtaggtcgcgttttcgggtacgtgcgttaggagtcgagttttagttcgtacgcgtcgtaaaagtttggttttatttttttatttcgaggtttagcgtttttttttcgcgtttagtgattttgtttttttcgtcgcgttcgtcgtttttagtatttgtagaagttttttatttcgttattaagtagttagaagtcgcgagatttttttattaatcgcgcgagatttttcgtagtatggcgttttagaacgcgttcgggattgcgcgtaggttttttttttcgcggcgtcgcgttcgtttttcggaaagtaggtttatacgtttgcgttcgcgtttaaggtcgtttattttcgcgagttttattatgatggcggcggagtgtgaagcggataagtggcgtagatgagtttagaagaagttaagcgacggcgatggcggtcgcgggtgttgaagatttcggagtacgtatattcgaaggttagcgagagttcgagattgaggcgaaagattgagtttgtttagtaatcgtttgtggaaaggcgacgacggcgttttcgtgatttcgcgtcgattaattaaagttcgcggtcgtttttatgagttaatcgcgagtttttaatcgtgaacggcgcggggcggggagtaggcgggtcgaggcggttacgggagggggaggggttggtaacggcgtcgtgggggcggggttcgttttgtgtaaggttcgcgttgattgggtcgtgggcgcgcgggtttcggtttgcgtcgtgggattggcgtttttggcgtcggttgtgaggggagcgcgggggtggtggaatcgggcggttttcggttcgttaatgtggttgggttcgtaggtttgggtagttttggagttttttagagatttcgcgttcggtttcggtacgtatttacgtcgcggtttttggtggttttggagcgaggagttcgttagtatcggaagtttagggatcgcggagttttcgttggtttttttggaggtatagtttatttttgtttgttcgcgagtatggggtcggtagtttttcggttgtaggtagttttttgagagttgttaataaaggtagtcgcgggtttgtgcgaggttttttgtgagaaatgtacgaattttttttattttatagaattttaagcgggagatatttttcgatatggggaacggtttcggagaagtaattttttggttttatagggtagggagaggggtttgggagggtcgatcgtagagtcgggtttttgatcgtttataggttttttggttattatttgggtcgaatgcgttaattaaggtggtggttgcgaagttagtgttattagatggttcgggagtaggtcgagagttatcggtagggtttttcggcggtagggcgaaggaggtcgttagtgatttttacggttagttttgtgggtgggttttattcgatgtcgggtttagtaaattagagtattttttttcgtttagggtttgtcggggatttattttatttataggtttagttatggatttatttatattttattgtttttatagaattaggatatttgtagttacggttgtatttgttaaaaattattttaggtcgggcgcggtggtttagattcgtaattttagtattttgggaggtcgaggcgtatgaatcggggaggcggaggttgtagtgagtcgagatcgtttattgtattttagtttgggcgatagagcgagatttcgttttagaaagaaaagtatttgttaaggtcgggtgcgatggtttatgtttgtaattttagtattttgggaggttgatgtaggaggatcgtttgagtttaggaatttgagatcggtttgggtaatataatgcgattttgtttttatataaaaaataattagcgggtatggtggcgttcgtttggagttttagttattcgggaggttgaggtgagaggatcgtttgagtttaggaggcggaggttgtagtgagtcgagatcgcgttattgaattttagtttgaggaataagagcgaaattttattttaaaaaaaaaaaaaagaaagaaaataaaattatttgttaaatgaatgaagtatttaggtagaagtagtagtagggagagtcggtatggtttaagtggcgttgttttggagttggtttggggtagtaaaatagtaatatttaatattttataatgttgatttagtgttaggcgtttttttagttttttatatattaattaatttattttttaaaataatttttttaaaaagttattattgttttatagaaattgggatatagaggtaaattaatttgtttaggggtcgtatagttagtagtggaggcgtaggatataagtgaagatattgttgtgttattttagttttttttttttgagatagaattttattttgttatttaggttggagtgtagtggtaggattatggtttattgtagttttgatatttttagttatattaattttttttttttagttttttaaaggtgagttattacgtttggtttgtttgtttttaaatgtttttttgtttttttttgaaaatatgagtatttattgaattgtaaagtatatatatagtgtaaaatttaaaagatttaaatagatgtataataaaaggtttttttttcgtttttgttttttaggttttttagttttaaggtagtggtagttttttgtatatttttttagatttagtcgtacgtgtaaatagataagtatatttgttatatttaatataaacgttattatatatattgttttgagttttttttttgtgttaattatatgtattttgtaatttattttatattagtatatgtagagttgttttattttttttaatagttatatggtattttttgtgtggaaggattataatttatttagttattattgttggatagttagggttttttgttatgtttggttattataaattgttatagtaaatatttttatttacgttattttatataaattatatttgtagaatagttgggttaagggtatggatttttatatttttatagatgtttttttaagtgttgtttttggttggggttttttatggtcgttttagttaagagcgattttatttgttttagttggtttagattatttgttgtttttgagttttaaggttgggagatagtgttttacgttttagtagaggaagaattagatggtggtgagaggtgtgagtatggttttaattattgtggggagtgtgattagttttagatattagttaagaagttgtagggatattattgttttgagtggttattggttgtttttttgggtttgtatggattcggtttaattttgtttgttgttgtggtttggttgttttttatgaaatttgtgtagtgaggtatttatttgggatatttatgggtatttttgatttttgagatttagtaggttatagtgggttttatatttatgttaggatttgatagtttattggagggggtttgtaggtttttaaggattaattttattttttaggattgggtttttaggaaataagtgttttagttaggttttaattagttaagaaaaattatattgagtatttaaaaaagagggagtttagcgtagggacgtggtgatatgagggatagaattgttgagaagtcgaggggattgagtaggaagtagttgttttttttttaggtttttttattgaaggttatgatgagggttcgggttgatgttagggaagttttagaaggttaggaggttggggatattttgtgttttttttgtttttttttttgagttgtaggtagggttggttagatttagttagtatttagtttataaagtttgtagggtgagtttttgttatgtaggtcgagtagggtagggttgggtattttagttggtcgggagggagtttatagttttagtttttagagttttaggtttgttgagtgtgaaggtttggggtgtttgttatgaagttttttttattagtttagtttttttttgttttttttttgtttttgggtttattgaggtttttggatattgtttagattttttttaatatttttttttagatgttaaagggggattttaagtttttttttttttgttaggttttgtttagtgtgttagcgagttttttttagaggaggtatttgtgttttagggttttaggagtcggagttagagaatttagtttttgttttttcgaggtagttcgagaagttttatttgtttatttagaggtagagttagttcgttgttaataattgtaggtttttgagtttgttggaggagggtgttgtgggttttagattaacgttatttttaatttttttgttgtattttttaggtttttttatttaggaggttgggttttgttggagagaaatttgtgatgatgtagatttggggtttttaaatgttttgtttttttagtagttgttttggtagtagttttagttgttagtttagattattttttaggagtttttgaacgtttttatttttttttttttagtttttatgttaagtttttttttttaggttttttatttttttttttttgttttttttgttaatagagttattttatttttttttttatagggaaggataaattttttagagggatttttattttttgatttttatatatttgtagatattttgagttttttttgttattttaaagttttaaggaaattagagtttttttttatagtatttttttttttgtgttagcgagtttttttttatttttttttggggtttttattatagtgatttttttagttgttattcgttatttttttgtgttttttggtgtgtgggtgtgtgggggtgtgggtgtgtgtttttggatttattttgttggttaggttggagtttagtggtgttaatatagtttattgtagtttcgatattttaggtttaggtgatttttttattttagttttttaagtagttaagattataggcgtttgttattacgtttagttattttttgtattttttatttgtttgtttttgagatagagttttgttttgttgtttaggttggagtgtagtggcgtaatttcggtttattgtaagtttcgttttttgtgtttaagcgatttttttgttttagtttttttttcgagtagttgggattttaggtatttattattacgtttggttaattttttgtatttttagtagagatagggttttattgtgttagttaggatggtttttattttttgattttttgattcgtttgttttagttttttaaagtgttgggattataggcgtgagttattacgtttggtttgttatttgttattttaatattttttttttttttattgttttttttaggaataagtttttgggaagagttgataatagttgtttttagttttattaggttttttaggtttttagtttttgtaggtgttttataattttgtttttgtaggt

SEQ ID NO: 35 - DNA, 6271 bp, Artificial Sequence
  Chemically treated genomic DNA (Homo sapiens)
  unsure 4779: n = a, c, g, or t
agtggtataaatatggtttattgtagtttttattttttgggattaagtaattttttagttttagttttttgagtagttgagatgatagttgtttatcgttatgtttagtaaatttttttattttttgtaaagatacgattttattatgttggttaggttggttttgaatttttgggtttacgcgatttatttgttttagtttttaaagtgttgggattataggtttgagttatggtgttcggttatatttatggatttaattgtttttggaattaatatcgtgtaggaaaggagtaggattgagtagaaaaagttgaattaaatgtagttatagtaaatgttttagttttcggattttaagggagttttggtgttaggagagttttttagagtagttttattttgagttttgtatttgttagttagtgtagacggatttggtgagaggtagttttttttagttgaaggtaatttttggaaagggatttagttgataggtgttgataagtaatgcgtttagtagttgaggaaatgagtattttagttttgaagagtggtgtgttttttggtatgttgggatggttggttgtgttagtggagatgggggtggtgggtagaatgaagggaatattattgtaaaagttttttattttttatttatatttatttatttatttattttttaagataaggtttaattttgatgttcgggttggagtgttggaatgtaatgatattattatagtttattgtagttttgattttttgggtttaagcgatttttttattttagttttttaagtaattggaattataggtatatgttattatgtttagttaattaaaaaaaaaaattttgtagagatgaggtttcgttatgttgtttagggtggtttggaatttttgggtttaagtgatttatttattttggttttttaaagtgttgggatgataggtatgagttacggtttttagtttggaataaaatttttcgaagaaaaaattggtagagtttgttgtttgattaaaaaatagaggttgaatgagagagatgtatttaaaataatacgaaatattaagggttttttgaatattgttggatagtgtaaaatgggggaagttaggatataaatttaattttgttttattgtaaggtttatgtttttttattagattagtgttggttaaattggtgttttatgggttatatttagatagtagacgtattttgtttggttatatagtatttaaaaaatgtaaattggttgttattatgtaaaaattggaagagtttatatgtaagtttagatttttagttttttttgagtaattagaagatttagtaatattgggttaatatttttgtatggtagtaattggagttgagtgatagatattttttaaatggagagagtattttttatttggataaatggaggtgggtatatgttttttaatttattatagtttttatgtattattttttttggtattttttttttgagatggagttattttgtcgtttaggttggattgtagtagtataatttaggtttattgaaattttagttttttgggtttaagtaatttttttgttttagttattttagtaagtagttgggattatagttatgtgttattatgttcggttttttttttttttttttttttttttagtagagatggagttttattatattggttaggttggttttaaatttttgattttaggtgatttgtttgtttcggttttttaaagtgttgggattataggtatgagttatagcgtttagttttttttggtatttttgtttagtatttttgttatatgtattatgtatggtttaataaagtatataatatataataggtatttgggtatttttatttttatttattttttagagatagggttttgttttgttgtttaggttggagtgtagtggcgagattatagtttattgtagttttgatttttttagtttaagtgatttttttattttagttttttaagttgttgggattatagatgtatattattatgtttaattaatttaaataattttttttggtagaagttgggattttattatgttgtttaggttggtttgaatttttaggtttaagtaatttttttatttcggtttttaaaagtgttggtattataggtgtgagttattacgatcggtttatttggatatttaatattggtttagtagaattgaatgaatttaattggagaggaagttggggtgaagtttaggtttttgattataatgagaggtttggtattgaggggaggtaatagaatagggagtataaattaggatgaattaatgatatgttggtaggagtttgagtaaaggaagaagagtagagggttagggtttgaagtttgggtgttttattatagagttaaagaagagtgggtaatggtagattaaattagagaagaagaggagagaaaggtatagaggaattttagtaacggaatgttagggaaggtaagggagttgagggtttgggtagttgtatttagtgtagggaagaagattagggagatagataggtaaaaagttatggtaataaggaagtagttagggatttttagaggaagtatgagaaaaggagaggaaggttataggtttgaagtttagtagtgtagtagggggtattggaatattattttgggggtatgagtgagtgtttttttaggggttttatttgggagaaatatagatagatatttatttaatatttatttatttttttttagtatagttattattttgatattatttaaaagaaattagtatttgtattgtatttttaaagaagaagggataaaagatatgtttaaattgtttgtttgttttagtggaataaaatattaatttaatatgtattttggataattattaatttagagattggaaattttttttaaggatatatttttttgtatgtgggttattggttttgtggtttttttgtaggaaaattaaaattttagttttgtttttttttattatttagtgtttgtgtggtttaattggttgattagcgcgtgtttggaatgtgtaaatttattttaatattggtttaggggtttgtgtggtagtttatttttgttattttagtattttgggaggttaaggtagggggattatttgaggttaggagttttagattagtttgggtaatatagtaagattgtgtttttattaaaaaaaaaaaaaaaaaaaaaattagttaaagtagggtgatatttatttgtagttttagttatttaggagtttgaggtgggaggattatttcggtttaggagtttgaggttggagtgagttatgattgagttattgtattttattgtatagagttagattttgtttttgaaaaataaaaatatttgtttaggtaaaatgtatcgaggaagataaattttaaaattatttattttaggttaggtgcggtggtttatatttgtaattttagtattttgggaggttgaggtgggcggattatgaggttaggagtttaagattagtttggttaatatggtgaaatatcgtttttattaaaaatataaaaattagtcggttgtggtggcgtatgtttgtagttttagttattcgggaggttgaggtagaagaattattttaatcgggaggcggaggttgtagtgagtcgagatcgcgtttttgtattttagtttgggtgatagggtgagattttgttttaaaaaaaaaaaaaaaaaaattagttattttaaagtttaatgttagatatagattattcgttgttttggatgtaattttttttttggaaaattggtataatttaattatatatgaaatttttttaattttggtattggaggtatagggaaggattttgttttaggagatttatagtttatttttattgttttaggagttaaattacgttggtttatattttgattttgttatttgttaatttagattttgggtaaattaaaggtttgagggaggagtgtaggtttttagcgtttttacgggggtggggacgtgacgtatttattagtttatgaagttaatgatatgtattgaaaaggtttgtttaaggatttaaataagacgatgaatatattgaattaataatgaatgtaaggttttaaaggtgttttgagggtggtgaaatttgaattttttattaattgtgtaatagttatattaatttggatggttatgagttttgtagaggaaagttgggtttaaattttaatgttagatttggtggttagattttgattgttatcgggtttagtattgggatttaagcgatttttaaaaaaaaaaaattacggaatttttttttggttttttttttttgttttttagtagtttattaagttacgaagaatttgaaaatcggaggtcgtgtattttattttttttgagagtttaagttgagagtatagtttttttaggagattagcggtagagattcgcgcgttgggagaaaggttagttttagggcgttttaatttttaatttcgggagtaatttaaattcggaggtcggcgggggaggggatagttgtagggggcggtggggatgggagtggatgttttcgggttagttttggtattcgttagttgagtttagcgttagtttaggtgagttttacggcggtgagggacgttcgttagacggtttagaggagttagatgacgttatttttaggaggattcgtttttttattaatgaaatcggtcggcgcgggcgtatgcgcggnaggtcgttttttttttcgtttttttttttttttttttagtcgcgtttttaatttttagttcgttcgcgtttttttttttcgggtcgtggaaaggattttattttcggtggggtgttatggcggcgtttcggattgtgatggttgtggggagacggcgttagtggggagagcgattaagaggttttttttttttttcgggttttttttttttatttttttttttttagtttttttgttaacgttttttttttttttttttttttcgttcggcgttgattttttatttttattttcgtgggaatattgggagtttgtattttatagattttttttttgtttttttttttattttagttttcgtttttcgtttttttttcggtttagggcgtcggtttattttttttttcgtcgtttttcggtcgcggggaggatatggtcgcgtataggtcggtggaatgggtttaggtcgtggttagtcgtttcgacgagtaggtaatcggttcgtggcgggcgggaggtgggagcggagtgggggtggggatagagtaggtgaggggaggtaggagcggtcgtttttttcgcggttgttttaggttttggaggaaaggaagggaagggaagagaagggaaggggggataagtgggggtggttaaggcgggaggtgaggggtaggaggggatagttgggagtttgggtatttttttttttttaagtcggggggtggggttttgtttttgattagttttcgattttttattttttttattttagttttttcgtttggaaatggggatgagtgatttgggggcgtttttaggggcgcgttatttggatttaataattatttttttatttttgtttttgagtagaggtgggtaacgtttaggggttttttttttttttttttttcgtgatttttttaattggggacgagcgaattttaaggtttgttttatatattttttataggagaacgataatatttcgttttttttttagtttttttagtttttttttttggagggggaagagtagaagaaagtaaggaaggtataggtttttttattttttgttttatcgttttattttgtttcgagagttttaagtgtatatttattgtatatttttgtgatgttttataacgtcgttttttatattttgatgatatagattgttttttttttttattgtcgtttgtagtggaaatcgtggttttgaaatattttttttttttttgataattgtagttttttttttttttttttttttttttgttagcggtttgaggatgtgatgtattttcgagtgagaatgttggggagtaaaggggagaagggtgaaaggaaagtgagaaattgttttagagttatcgataatagagtaaagttagttgggatgtggttttggagcggattattttgttagtgtttgtggttgtttttgatttttttttggttgataagagaatttttattgagaatatttgggatg

SEQ ID NO: 36 - DNA, 6271 bp, Artificial Sequence
  Chemically treated genomic DNA (Homo sapiens)
  unsure 1493: n = a, c, g, or t
tattttaaatatttttaatgaaagtttttttgttaattaggagagagttaaaaataattataaatattagtagaatgattcgttttaggattatattttagttggttttgttttgttgtcggtggttttgaagtagttttttattttttttttattttttttttttttattttttaatatttttattcgagaatgtattatatttttagatcgttggtaaaaaaaaaaggggggggggaagagattgtaattattaaggaaggggaaggtattttagaattacggtttttattgtaaacggtaataaaaaaaaaaggtagtttgtgttattaggatatgggggacgacgttgtagggtattataaagatgtgtagtgagtgtgtatttgaagttttcggggtaggatgagacgatggagtagaaagtaagaaaatttgtgttttttttgtttttttttgtttttttttttttaggagaggaagttgaagaaattgggggaggggcggaatgttatcgtttttttatagagggtatataagataggttttagggttcgttcgtttttagttaggagggttacggagggaagaggaagagagaatttttaaacgttatttatttttgtttaaaaataaaagtaagggggtaattattaaatttagatggcgcgtttttaaaggcgtttttaggttatttatttttatttttaagcggaagggttgggataaaggggatggagggtcggaggttggttagggataaggttttatttttcgatttaggagggaaagggtgtttaagtttttagttgtttttttttattttttatttttcgttttggttatttttatttatttttttttttttttttttttttttttttttttttttttagagtttgaggtagtcgcgggggaggcggtcgtttttatttttttttatttattttgtttttatttttatttcgtttttatttttcgttcgttacgggtcggttatttgttcgtcgaagcggttgattacggtttggatttattttatcggtttgtgcgcggttatgtttttttcgcggtcggggggcggcggagggaagggtgggtcggcgttttgggtcgggaagagggcggggagcggaggttgaggtgagggaagaggtaaggagagggtttgtggagtgtaggtttttagtgtttttacgggggtggggatggggggttagcgtcgagcgggagggggagagggaaagggggcgttggtaaggaggttggggggagggggataggggaaggggattcggggaggggagggggttttttggtcgttttttttattagcgtcgtttttttatagttattatagttcgagacgtcgttatgatattttatcggaagtgggattttttttacggttcggggagagggagcgcgagcgagttagagattgagagcgcggttgggaaaggggagggggaagcgagagggaaggcggtttntcgcgtatgcgttcgcgtcggtcggttttattaatgaaaaagcgagtttttttggaggtgacgttatttaatttttttgggtcgtttggcgagcgttttttatcgtcgtggggtttatttagattggcgttgggtttagttggcgagtgttagagttgattcgggagtatttatttttatttttatcgttttttatagttgttttttttttcgtcggttttcgggtttggattgttttcggagttggaagttagggcgttttggggttagttttttttttagcgcgcggatttttgtcgttaattttttggggaggttgtgtttttagtttaagtttttagaaaaaataaggtatacgattttcgatttttaggtttttcgtagtttggtagattgttgagaaataaaaaaggaaggttaaagagagatttcgtgattttttttttttagaggtcgtttaaattttaatgttagattcggtggtaattaaggtttagttattaggtttagtattgggatttaagtttagtttttttttgtaaaatttatagttatttaagttaatataattattgtatagttgatgagagatttaagttttattatttttaaaatatttttaaggttttgtatttattattaatttaatatatttatcgttttatttaaatttttgaataaatttttttaatatatattattaattttatgaattgatgaatacgttacgtttttattttcgtgggaacgttgggagtttgtattttttttttagatttttgatttgtttaaggtttgagttgataggtggtaaagttaggatgtaaattaacgtggtttaatttttagaataatagaggtagattatgggttttttaaaataaagtttttttttatatttttaatattagagttgaaaggattttatgtgtaattgggttgtgttagttttttaggaagaggattatatttaaaataacggataatttatgtttgatattggattttggaatgattaatttttttttttttttttttaagatagagttttattttgttatttaggttggagtgtagaggcgcgatttcggtttattgtaattttcgtttttcggttgaagtgatttttttgttttagtttttcgagtagttgggattataggtatgcgttattatagtcggttaatttttgtatttttagtagagacggtgttttattatattggttaggttggttttgaatttttgattttatgattcgtttattttagttttttaaagtattgggattataggtgtgagttatcgtatttggtttggaatgagtaattttaaaatttgtttttttcgatatattttatttaggtaaatgtttttgttttttagagataaggtttgattttgtgtagtggagtgtagtggtttaattatagtttattttagttttagatttttgggtcgaagtgatttttttattttaagtttttgaatagttgggattataggtgagtgttattttgttttggttaattttttttttttttttttttttggtagagatatagttttgttatgttgtttaggttggtttggaatttttggttttaagtgatttttttgttttggttttttaaagtgttgggatgataggggtgagttattatataggtttttaggttaatgttaaaatgaatttatatattttaagtacgcgttaattagttagttaagttatatagatattgggtgataagggagaataaaattagaattttaatttttttatagaaaagttataaagttagtagtttatatatagagagatatatttttgagaaaagtttttaatttttaggttggtggttgtttaaaatatatattaaattaatgttttattttattagaatagatagatagtttggatatgttttttgtttttttttttttaaggatgtaatgtagatattaattttttttagatgatgttagaatgatgattatgttggaaagaaatggatgaatattaaatgaatgtttatttatgttttttttaagtaggatttttgaaaaagtatttatttatatttttaagatagtattttagtgttttttattgtattgttaaattttagatttatgattttttttttttttttttatattttttttgaaagtttttaattatttttttgttgttatggttttttgtttgtttatttttttgatttttttttttatattggatgtaattgtttaaatttttagtttttttgttttttttggtatttcgttgttgaagtttttttgtgttttttttttttttttttttttagtttagtttattattgtttatttttttttagttttgtggtaagatatttaaattttaggttttggttttttgtttttttttttttatttaagtttttgttagtatgttattaatttattttaatttgtattttttgttttgttgtttttttttagtgttaaattttttattatagttagaggtttagattttattttaattttttttttaattaaatttatttagttttgttgaattagtattaagtgtttaaatgggtcggtcgtggtggtttatatttataatgttagtatttttagaggtcgaggtgggaggattgtttgagtttagaagtttagattagtttgggtaatatagtgagattttagtttttattaaaaaaaattatttaaattagttaggtatagtggtgtgtatttgtggttttagtaatttgggaggttgaggtgggaggattatttgagttagagaggttaaggttgtagtgagttgtgatttcgttattgtattttagtttaggtaatagagtaagattttgtttttaaaaaataaataaaaataaaagtatttaaatgtttgttatgtattatgtattttgttagattatatatagtatatatggtaggaatgttaaataaaagtgttaaagaagattggacgttgtggtttatgtttgtaattttagtattttgggaggtcgaggtaggtagattatttgaggttaggagtttgagattagtttggttaatgtggtgaaattttatttttattaaaaaaaaaaaaaaaaaaaaaaaaagtcgggtatggtggtatatggttgtaattttaattatttattagggtgattgaggtaggagaattgtttgaatttaggaggttgaggttttagtgagtttagattgtgttgttgtaatttagtttgggcgatagagtgattttattttaaaaaaaaaatgttaaagaaggtaatgtatagagattgtggtgaattaagaagtatatatttatttttatttatttagataagagatattttttttatttaaagagtatttgttatttaattttagttattgttatgtaggaatgttgatttagtgttgttagattttttagttatttaagagaagttagagatttgaatttatatgtaaatttttttaatttttatatagtggtagttaatttatattttttaaatgttgtgtagttaaataaaatacgtttgttgtttgaatgtagtttatggaatattagtttgattagtattagtttagtgaaaaggtatgagttttatagtagaatagaattagatttgtattttaattttttttattttgtattgtttaatagtatttagggaatttttagtgtttcgtattgttttaaatgtattttttttatttagtttttgttttttggttaggtaataagttttgttaatttttttttcgaagagttttgttttaagttgggagtcgtggtttatgtttgttattttagtattttgggaggttaaggtgggtggattatttgagtttaggagttttagattattttgggtaatatggcgaaattttatttttataaaatttttttttttaattagttgggtatggtggtatgtgtttgtggttttagttatttgggaagttgaagtgggaggatcgtttgagtttaggaggttaaggttatagtgagttgtgatggtgttattgtattttagtattttagttcgggtattagagttagattttgttttaaaaaataaataaatgaataaatataaataaaaaataaaaagtttttatagtagtattttttttattttgtttattatttttatttttattggtataattaattattttagtatattaaagagtatattattttttaggattaaggtgtttatttttttagttgttgggcgtattatttgttaatatttattagttaaatttttttttaggagttgtttttagttgaagaaagttgttttttattaggttcgtttgtattgattggtagatgtagggtttagggtggggttgttttgaagggtttttttggtattagagtttttttaggattcggaagttgaggtatttgttgtaattatatttagtttaattttttttgtttaattttattttttttttgtacggtgttgattttaagggtaattaaatttatgagtgtggtcggatattatggtttagatttgtaattttagtattttaggagttgaggtaggtggatcgcgtgagtttaagagtttaagattagtttgattaatatggtaaaatcgtatttttataaaaaataaaaaaatttgttggatatggcggtgagtagttgttattttagttatttaggaggttgaagttggaggattgtttgattttaggaggtagaggttgtagtgagttatgtttgtattatt

SEQ ID NO: 37 - DNA, 8693 bp, Artificial Sequence
  Chemically treated genomic DNA (Homo sapiens)
agtttggataagatagcgagatttcgttttaaaaaaaaaaaaaaaaaaaagtataggaatgaggtattggagttagtagttgtagttttttaagagttaagttttttgtattggaggatatttagtgtatatgtgttattgatggttatggtttgagtaggtagtttgagttttttaggttgttttgagggtttttgttgatgcgagtttttattgaaaagtttagttgaggatattgtgttgaggaggttgtgggagggaggaagtatcgagtcgggtatgggagttttttcgttgtttgtgagttttttttttttgttgaattagtttttatttgattttttttaatcgttaggtgatagagattaggaagaaagaggttttatatatgtttttcgaggatgtgtttgtggagaggtttaggtgaggagaggacgggggacgtggttagggatttttagggtagttgagtaagtaggtgggtggtttgaggttaggaggggttaatgttaggaggtttagatttttgtggatttaagggtagaaggtgggttttgttgtggtttaggagttttgggtaaagtttaattttattatattattgtagtttatgtttcgagtatgtaatgttgagttatgtttgtagatgagatatagttttcgggggttttggttaagtttatgttaaatgtattttggaggagttatttttgataagatattattgtaaatttaagtaatgttttcggattatagtgggtgttgtgggttagtgttattttaatattagaggaatttaagggaaagatgttttgtaaaattaaaatgtttaatagtaggggatggttttataaattatggtttatttatatagtagataattatgataatgttttagaagaatatttaatgtaaaatatttattatataaataggttaataaaatagattatagaatagcgggtggggaaggggatatttgtgtatatttaaaaatacgggattaagttgggtgcggtggtttacgtttgtaggtttagcgatttagaagattgagtaggaggattttttgagtttatgagttcgagataattatgggtcgtaaagtaagaatttatttttataaaaaatgtttaaaaattttgttcgggttggtatagtgatttacgtttgtaattttagtattttgggaggttaaggtgggcggattatttgaggttagaagttcgagattattttggttaatatggtgaaattttatttttattaaaaatataaaaattagttaggtatggtggcgtatatttgtagttttagttattttattcgggaggttgaggtaggagaatttgtttgaatttaggaggtaaaggttgtagtgagtcgagattatgttattgtattttagtttgggtaatagagtaagattttgtttaaaaaaaaaaaaaaaaaattaggtcggttatagtggtttatgtttatgtaattttagtattagtattttgggtggttgaggcgggtagattatttgagattaggagttggagattagtttggttaatatagtaaaattttgtttttattaaaaatataaaaattagttaggtgtggtggcgtgcgtatgtaattttagttatttgggaggttgaggtaggagaatcgtttgaatttgggaggtagaggttgtagtgagttgagattatgttattgtattttagtttgggtaatagggagagatttggtttaagaaataattataataataaataaataaataaataaaattagttaggtatggtggagcgtatttgttgggaggtagagtaggaagattattttagtttggtaggttaaggttgtagtgtgttatgatggtgtttgtgaatagttattgtattttagtttgggaaatatagtgaggattttgtttttaaaaaataaaaagggggagggaagatggatttttaatttgttttatgagaatagtataattttttgatatttaaattagataagaattttataagaaaggaaaattataggtttattttatgaatattaatgtaaatgttttaaataaaatattagtaaattgagtttagtgttttttgtataaggataatatattataattaaattgggtttaatttaagaagttatggtaggtttaatattaaaaaattaataatgtaataatttattatattattagaataaaggtgaaaaattatgttatgttagataattaaaggtatttgttttaggtttttaaagaggagttagtggtataaggatgtaagggtagtggtgatttttttttagtggtattagttgaagtgagaatggtagcgttttattttggggatagaagtgacgtttatgttagacgtttgtggttttgatatgttttttgtggttttttgtggtttgttttttttttttttattggatgtgattttggttatggttttagttatattgtgtttttgtttatttttagattttggttttttaatttgtttagtgatttttttttttttttagatggagttttgttgtgtcgttaggttggagtgtagtggcgcgatttcggtttatcgtaattttcgttttttaggtttaagcgatttttttgttttagttattcgagtagttgggattataggtgtgcgttattacgttcggttaatttttgtatttttagtagagacggggtttcgttattttggttaggaatgtttttattttttgatttcgtgatttgtttaatttagttttttagagtgttgggattataggcgtgagttattgtgtttcgtttatttagtgattttaaatgtagtttaatggttttttagtttatggaggttaaagtaggttttgttgtattaaattaagaaattgggttgggtgtggtggttaatatttgtaattttagtattttaggatattgatgtggattatttgagtttaggagtttgagattagtttaggtaatatagtgaaattttgtttttattaaaaataaaaataaaaataaaataaaaaattaaaatttaaaattagttgggtatggtggtatgtatttgtggttttaggtatttaggaggttgaagtatgaggattatttgagtttaggaggtggaggttgtagtgagtagtgtttatattgttgtattttagtttgggtaatagagtgagattttaatttaaaaataaataaatagaatgagagagagagagaagaaaagaaagaaggaatttagttaaagaagttgggtttatttggattttttttggtttgttttatttgttgttattagtagttttttgaagttataaaaataatataaagtaaaataaggtaaaattattatttgtttgaaagagtttataaatttgatggtggtcgtggggtggatggaagattaaaaaaatggggatagaagtgaattagtgtaagttatttgtattgataagatggggatggatttttgtggaaggtagaggaggttatgttttatgtttttggtaggaaaagtggttaaagagggttttagagaataggggttgatggatgggttatattttgatgtgagttaagtttttggatggttggagagaggaaggatgttttagttgggggaatagtttggataatggagatttaagaaagttatgttttagtagtgtgaatgttgtggatgttgaagtgttaggatgtaaggtggagaattgggaaatggttttggaaaggggcgaaagtcgggtgatgaagtattttgtttattgtgacggagtttggattttttttgtggtttaaagggaaaggattgttgaatgtaaagttaatgttattagaaaagttgaatttataagagagttttggagtttaaaagagtattttatggggaattaggaaagttttggtatttggtagattaagtaagtgttttgatttgaagtttagtttagttttaatatttttttttatatttattatatcgtataatttggttttgtttatttattttaggttaaggtagagttttttagtttggtttgagtgttgtatttttttttttggtttgatatttggaattaaagttaagttagaattttagggttaagggggatgttgaaaattgtttgagtttttagattattttgttagtttatggtaaagggagggattagaggttatagggaaagtattttagttgttttttatagtattattttttttttatttaatggtttaggttaataggattttttttttgaggtttgggatacggaagggagttttttttaaattaggtttttggagagtaggttttaggggagtagtgtaatttatttttatatttataagacggtttttgatttttgttttttttttttttttttaaagtggaatagagagaatatgattttttacgatttttatattatagtttttaaataatggggaaatcggaggttttttcgtgtgtagacggtgatatttatcgttaaatgcgaattaggtagatgttagttttagtacgtacgtaggtaattttattttcgttttaacgattttagaggttgttcggtttgttttatacgggggtgttaagtttttcgttcgttttaagcggagatttaacgttatttataattaagttttttttgagggcgagcggttaggtgcgttttcggtaggatagtgttaattttagtttttttttagcgcgttttttcgcgttcgtttttcgtttggaagttttttttttacgtttcgcggtttttttttttttggttcggggagttgttttttgtgttgtcgggaaggttaaagtttcgcgtttattaggagagttcggtaagtatataaggatagaggagcgcgggattaagcggcggcgaaggaggggaagaagagtcgcgatcgagagaggtcgtcgagcgttttcgtttttagagagtagtttttcgagataggtaagggcgtagcgtgggggattcgtgtttttttttcgggattttttgttttcgttttcgcgatgtagtcggtcggtttcggtttcgaaggcggatttgggcgtttttggtttttcgcggtttcgagttttcgataaattttttgcgtcgattgcggtatgagaagtcgttagtagttgagttggagggtttacgttcggtttttgggcggacggtcgcgaagttgtaggcgttgtttttagggagtcggcggtttttttttttttaggggttcgcggcggttcggaggtttcgagagtttgttaggaggttttgggataattcggtttttttttttttttttgagacggagtttcgtttttgttgtttatgttggagagtaaaggggtgatttttgtttatcgtaattttcgtttttcgggtttaagcgatttttttgttttagtttttcgagtagttgggattataggtatgcgttattacgttcggttaatttttgtatttttagtagagacggagtttttttatgttggttaggttggttttaaattttcgataataggtgattcgttcgttttggttttttaaagttttggtattataggcgcgagttatcgttttcggttagttcggttttttagtattttttgtttttagtttttaggataggtgttatattttgaaagttaaattttatatacgttatcgtaaattaatgttggaaacggggtagtagagaaaaggataaaagttataatgaacgttttgtttttcggattttttcggatttagatttttgaatttttgtttttttgtttattttagcgtattcgaggtggtcgcgttatgataattatatgataattgggttaattataatgtagaatagttgggttttttttttttaagatttagttggggttaaaaataggtggtcggggcgggatttgttttagattttgaaacgtattgtttagtttcggatgttttaatagaatcggggtggacggtttatggcgtagattttgggttgagggtacgggtagttatttaggaatgattaaggtttaggtaagggggcgtttttagcgaaggagagatagtttatttggtatttggattttttaaattttttatgtttaaatggggtagggagggtttttatagaatggttggaaggagttaaggaaaataaaagtgtgtgtggattttttttgtgtgtgtgttagtttataaattttgtatagattatggttattttaatgatttattgtttttttgatgtttttgttataggattcgatgtatgtatgttatggtgtaaggataaaattcggtttttgtgtttttttaatttttataaaaggttatggttagcgtgtagttttatagtaataagtaaaatgatttgttgagtttatagagagttttttatatttatgaagttttaataagtgtagttttattataaagttaattttaggatgagtaaattttaagtttttatttttttagagttttttatttttggattataatattttttttatttaaaaaagtataatatttgatatttttttaataatttgttgttttaaaaatgatataaaaggtattatttgtttattgtagagaattgaaaatatatataagtaaatatatatatatataagtaaaatatataatataaatataagattattttttagggaagaatttgaagttttagtaatagtagttatttaattagtttagtaatagaatataagttttgagagggtgggagtgaatatgttattatattgtataatatagtatatagggtataaggaggggaaatgttttttggggttttttaggaaggtttgaagttattgtttttagtaaatggaaattattttagagtagttatttttgataagaattgaaatataattgagggaattattagatttgtaagattttgtttttttttttattaatatgttattttatatttgtatttggtgatatacgtaattattatttttttgtgattgtaatatttgggtattttttagagttaaatgtgttatggttaatttggagttttaatttaattgtttggtttattaagttttggttgtgtatttgaatagattattggtagggtataatgggaatagtttgttttttggagttaggagaggatattaaggttgattaaagttcgtttagttgtttttttagtcgaagcgtatttgggttagttattggttgttagtgttatttaatggttgttttgaaaatgtttagttttgttcggtaattttttagaagttagtatcgtgtaggtttagcgtttggggaatagggcgagggtggggtagagagaaggaagtggttttttgaagtagaaattagcgttttagaggatttttatttttaaagttttttttatataaaaaagatttggtttacgtttttttaaatgagagatttattttaggtaaatttattttaaaatgttagcgtttattaggagtgataagatatttagttatttacgttttaatgtgaattattttttttatttaattatatttttttttagtagttggttgagaagattttttgaaatttaaaatgattgtagggttggcggtgagttgattttcggtttcgaggtggttttagggggtttatttggttaagggaaatttggtagtgcgagggtagtgttggagagaggggtgggtatagggggttaggggtattatggatgttttttttttattgttttttggtgttttgattttagtttttgtttataggtatttgttggattttttaaaagtatttgtagtggttgttttattaggaggtaatttttttttggttttttttttttttatatttgtattttttttaaattttgttattttagattatatttgagagttttagagaataagatatttgatacgtgacgtgtttagaagatgagttagattttaaagaattgagatttgttttaaaaacgaagttttttaaagttattggagtttgggtaatagtgattattagagtaatttgtgtgtaggatattaaattaggttgttcgaaatgttgtttaaattggttagtggttttatttgtttttttgttaatttaatatttataggaaatagagttttagaggaatgataggattttggtggaataaaaagggaaaagattattttgagtaggagttttagggtttttcgttttttttaagttatttttatttttgagattttgtatgttagaattatagtttaatgtagtgaaataggaaagttttttgttaggagtttagttttattttgttatggatattaaagtaattgtttttttttgggttttaatttttttattttttatgggaagggttgaattaagtaatttttaaaatagtttttagttttaatttttttaggggtttcgtttaaatagaagataatagggaaatggttatagtttatttattatttttttttttttattataatttatattatcgttgtattgtatatttttttttttagtattgttgttgtttttaaaatgtttttaattttataagagagtgtgttgttaatgttggtttaaggttttttttggtgagtggttaatattgttttgttttttgtaggggttttattaattttgtttgtttttgtaga

SEQ ID NO: 38 - DNA, 8693 bp, Artificial Sequence
  Chemically treated genomic DNA (Homo sapiens)
tttgtagaagtaaataagattggtgggatttttgtaaggagtaaaataatgttggttatttattaggaaggattttgagttaatattaataatatatttttttgtggagttaaaggtattttaaggatagtagtaatgttgagaaaggaggtgtgtagtatagcggtggtataagttgtgataaggaggagggaatggtgggtaaattgtgattatttttttgttattttttatttaaacgagatttttaaaaaggttaaggttggaagttattttggggattgtttggtttagttttttttatgagagatgggaaaattgaagtttaaagagagataattattttaatgtttatgataaggtaaggttaagtttttaatagagaatttttttattttattatattaagttgtagttttaatatgtaagattttaggagtgaaagtaatttgggaaaaacggaggattttgaaatttttgtttaagatggttttttttttttttattttattaggattttattatttttttgaaattttattttttatgaatattaggttgatagaaaagtaaataaaattattggttaatttaggtagtatttcgagtagtttgatttgatgttttgtatataaattattttggtgattattattatttagattttagtaattttggagagtttcgtttttaaagtagattttagttttttgaaatttggtttattttttggatacgttacgtgttagatgttttgttttttagagtttttaaatgtggtttgaaatggtaggatttgaagaggatgtagatgtggaggggaaagagattagaagggaattattttttggtggaatagttattgtagatatttttggagaatttagtaagtgtttgtgggtagaagttgaggttaagatattaggggatagtaaggagggggtatttatggtgtttttagttttttgtatttatttttttttttagtattattttcgtattgttaaattttttttaattaggtgggttttttgaagttatttcgaggtcggagattagtttatcgttaattttataattattttggattttagaagatttttttagttagttgttagaaagaaatgtaattagatgagaaaagtaatttatattaaagcgtggatgattaagtgttttgttatttttaatgaacgttggtattttaaaataagtttgtttaaaataaattttttatttggggaggcgtgggttaaattttttttatataggggaggttttggaagtgaaagttttttgaagcgttgatttttattttaggaggttatttttttttttttattttattttcgttttattttttaggcgttgggtttgtacggtgttagtttttgaagggttgtcgggtaaggttgagtatttttagagtagttattagatggtattggtagttagtgattggtttaggtgcgtttcggttaaaggggtaattgaacgagttttggttaattttggtgtttttttttggttttaagggataggttgtttttattgtattttgttagtgatttatttaagtatatagttagaatttggtggattaggtaattagattaaagttttaagttgattatagtatatttagttttgaaaaatgtttagatgttatagttatagaaaaatggtagttacgtatgttattaaatgtaaatgtaaagtaatatattagtaaaggaaaaaataaaattttataggtttgatagtttttttaattatattttaatttttgttaaagataattattttggagtgatttttatttgttagaagtaatgattttaggtttttttggaaagttttagagagtattttttttttttatgttttatgtgttgtgttgtataatgtggtaatatatttatttttatttttttagagtttatattttgttgttaaattggttagatggttgttattgttaaaattttagatttttttttgaaagatggttttgtgtttgtattgtatattttgtttatgtgtatgtgtatttgtttatgtgtatttttagttttttataatgaataaatagtattttttgtgttatttttaaagtaataaattattggggaaatattaaatgttgtgtttttttaagtagggaaagtattataatttaaaaatggaaagttttggaaaaatagaaatttgaaatttgtttattttgagattaattttatagtagaattatatttattagaattttataggtgtgaggggttttttatgagtttaataaattattttgtttgttattgtaaaattgtacgttggttatgattttttgtaaagattagaggagtataggggtcgagttttgtttttatattatgatatatatgtatcgagttttataataaaagtattaaaggaatagtaagttattaaagtggttataatttgtgtagagtttataaattgatatatatataaaaaaaatttatatatatttttattttttttggttttttttagttattttgtaagaattttttttgttttatttaaatatgaagaatttggggaatttaaatgttaagtggattgtttttttttcgttgaaaacgtttttttatttgagttttgattatttttaaatggttgttcgtgtttttaatttaggatttgcgttataaatcgtttatttcggttttgttgaggtattcgaaattagatagtgcgttttaggatttaggataagtttcgtttcggttatttgtttttaattttagttaggttttggagagaagagatttaattattttgtattgtaattgatttagttattatgtaattattatagcgcggttatttcgggtgcgttaaggtgggtaaggaaataaggatttaggggtttgaattcgaaaaaattcggaaggtagggcgtttattatgatttttatttttttttttgttgtttcgtttttaatattaatttgcgatagcgtgtatggaatttgatttttaagatgtgatatttattttggaaattgggagtaagagatattaaaagatcgggttggtcgggggcggtggttcgcgtttgtaatgttagaattttggggggttaaggcgggcggattatttgttgtcgggagtttgagattagtttgattaatatggagaaatttcgtttttattaaaaatataaaaattagtcgggcgtggtggcgtatgtttgtaattttagttattcgggaggttgaagtaggagaatcgtttgaattcgggaggcgaaggttgcggtgagtagagattatttttttgttttttagtatgggtaataagagcgaaatttcgttttaaaaaaaaaaaaaaagatcgggttgttttaagattttttagtaagttttcggagttttcggatcgtcgcgagtttttgggggagaggaggtcgtcggttttttggagatagcgtttgtagtttcgcggtcgttcgtttaggggtcggacgtgggttttttagtttagttattggcggttttttatgtcgtagtcggcgtagaaagtttgtcgagaattcgggatcgcggagagttagaggcgtttaggttcgttttcggagtcggagtcggtcgattgtatcgcgaggacggggataggggatttcggggaaagagtacgggttttttacgttgcgtttttatttgtttcgggaggttgttttttgagggcggggacgttcggcggtttttttcggtcgcggtttttttttttttttttcgtcgtcgtttggtttcgcgtttttttgtttttatatatttgtcgagtttttttggtgggcgcgggattttgattttttcggtagtataaggagtagtttttcgggttaggggaaggggggtcgcggggcgtgggaggggggtttttagacgggggacgagcgcggggagacgcgttggaaaggggttggaattagtattgttttgtcgaaggcgtatttggtcgttcgtttttaggaagaatttaattatggatggcgttgggttttcgtttagaacgggcgggaggtttagtattttcgtgtggggtaggtcgggtagtttttgaggtcgttgaggcgagggtgaagttatttgcgtgcgtgttggggttggtatttgtttggttcgtatttggcggtaaatattatcgtttgtatacggggaggttttcgatttttttattgtttggaaattgtgatgtggaagtcgtggggaattatattttttttgttttattttggggaggggaggagggagtagaagttaggagtcgttttgtgggtgtgaaggtgagttgtattgtttttttggggtttgttttttaagggtttggtttaggggaggttttttttcgtgttttaagttttaaggaaaaagttttgttaatttaaattattaaatggggagagggtgatgttgtgaagagtagttgaagtgttttttttgtggtttttgatttttttttttgttatgagttggtagggtggtttggggatttagataatttttaatattttttttggttttggagttttggtttggttttagttttaaatattagattagagagaagagtatagtatttaaattaagttaagagattttattttaatttggagtaaataaataaaattaaattgtgcgatgtggtgggtgtgggagggagtattgggattaaattggattttaaattaagatatttgtttaatttgttaaatgttagaatttttttgattttttatgagatgtttttttggattttaggatttttttgtggatttagtttttttggtgatattggttttatatttagtaattttttttttttggattataagagagatttaagtttcgttatagtagataaggtgttttattattcggttttcgtttttttttagggttattttttagttttttattttgtattttggtattttagtatttataatatttatattgttagaatatggtttttttgggtttttattgtttaagttgtttttttaattagaatattttttttttttttagttatttaggagtttgatttatattaagatgtagtttatttattagtttttgttttttgaagttttttttggttattttttttattaggggtatgaggtatgattttttttgttttttatagaagtttatttttattttgttagtgtaagtggtttgtattaatttatttttgtttttatttttttaattttttatttattttacgattattattaggtttgtaaatttttttaagtagatggtggttttgttttattttattttgtgttatttttgtaattttaggaggttgttggtggtagtagataaaataaattaggaaaaatttaaatggatttaatttttttaattgggtttttttttttttttttttttttttttttttattttgtttgtttgtttttgaattagggttttattttgttgtttaggttggaatgtagtagtgtgaatattgtttattgtagtttttattttttgggtttaagtgatttttatgttttagttttttgagtatttggaattatagatgtatgttattatgtttagttaattttgggttttggttttttgttttgtttttgtttttgtttttggtagagatagggttttattatgttgtttaggttggttttaagtttttgggtttaagtaatttatattagtattttgaagtgttgggattataggtgttagttattatatttagtttagttttttaatttaatgtagtagaatttgttttggtttttatgaattgaaaggttattgaattgtatttagaattattgggtaggcggggtatagtggtttacgtttgtaattttagtattttgggaggttgagttgggtagattacgaggttaagagatggagatatttttggttaagatggcgaaatttcgtttttattaaaaatataaaaattagtcgggcgtggtggcgtatatttgtagttttagttattcgggtggttgaggtaggagaatcgtttgaatttgggaggcggaggttgcggtgagtcgagatcgcgttattgtattttagtttggcgatatagtaagattttatttaaaaaaaaaaaaaaattattgggtaggttgggggattaggatttaaaaatgggtagggatatagtgtggttggaattatggttaaaattatatttagtggagaaaaaaaaaatagattataaggggttataaggggtatgttaagattataggcgtttgatatagacgttatttttgtttttaggatgggacgttgttatttttattttagttaatgttattagaaaggagttattattgtttttgtatttttgtattattagtttttttttgaaagtttagaataggtgtttttgattgtttgatatgatataattttttatttttattttagtaatgtggtgaattattgtattgttgattttttggtgttaaatttattatggttttttagattaaatttaatttgattatgatgtattatttttatatagaaagtattggatttaatttgttaatattttatttaagatatttgtattgatgtttatgagatgggtttgtaattttttttttttgtggaatttttgtttaatttgagtattaaaaaattatgttgtttttataaaataagttggaaatttattttttttttttttttttattttttaaagatagggtttttattgtgttttttaggttggagtgtagtggttatttataggtattattatagtatattatagttttgatttgttaggttaaagtgatttttttgttttgttttttaataggtacgttttattatatttggttaattttatttatttatttatttattattataattattttttagattaagtttttttttgttgtttaggttggagtgtagtgatatgattttagtttattgtaatttttgttttttaggtttaagcgatttttttgttttagttttttaagtagttgggattatatgcgtacgttattatatttggttaatttttgtatttttagtagagatagggttttattgtgttggttaggttagtttttaatttttgattttaagtgatttgttcgttttaattatttaaagtgttagtgttgggattatataggtataagttattgtgatcggtttaattttttttttttttttttagatagagttttgttttgttgtttaggttggagtgtagtggtatgatttcggtttattgtaatttttgttttttggatttaagtagatttttttgttttagtttttcgagtagagtagttgggattataggtgtgcgttattatatttggttaatttttgtatttttagtagagatggggttttattatgttggttaggatggtttcgaatttttgattttaagtgattcgtttattttagttttttaaagtgttgggattataggcgtgagttattgtgttagttcgggtaaaatttttaaatattttttgtagagatgggtttttgttttgcggtttatggttgtttcgaatttatgggtttaagagatttttttgtttagttttttgagtcgttgggtttgtaggcgtgagttatcgtatttagtttagtttcgtatttttaaatatatatagatatttttttttttattcgttgttttgtgatttattttattgatttatttatgtaatgggtattttatattaaatatttttttaaaatattgttatgattgtttattgtatggatgggttataatttataaagttattttttattgttagatattttggttttgtaaaatattttttttttgagtttttttgatgttgaaatgatattggtttatagtatttattatgattcgaaaatattatttggatttatagtaatgttttgttaggaatgatttttttaggatgtatttagtatgggtttggttaaagttttcggaggttgtgttttatttgtaaatatggtttagtattgtatgttcgaggtatggattgtagtaatgtgatggggttgaattttatttaggatttttggattatagtagagtttattttttgtttttgagtttatagaagtttgagttttttggtattgattttttttgattttagattatttatttgtttatttagttgttttggggatttttgattacgtttttcgttttttttttatttgggtttttttataaatatattttcggggagtatgtatggagtttttttttttttggtttttattatttggcggttgggaggaattagataagagttggtttagtagggagagggagtttataggtaacgaaagagtttttatgttcggttcggtgtttttttttttttatagtttttttagtatagtgtttttagttgagttttttagtggaaattcgtattaatagggatttttagggtagtttgagaagtttaagttgtttgtttaggttatggttattaatgatatatgtgtattaagtgttttttaatgtagggaatttaatttttaagagattgtagttgttggttttaatgttttatttttatgtttttttttttttttttttttgagacggagtttcgttgttttgtttaggtt

SEQ ID NO: 39 - DNA, 8085 bp, Artificial Sequence
  Chemically treated genomic DNA (Homo sapiens)
  unsure 2545: n = a, c, g, or t
gttttatgatttaattattttttaatatttttttttattaagattattatattggtgattgggttttgatatatagatttggggagaatataaatatttatattatagtatttattaatttatttagttattttattgttaggtatttatttagaaaaaatgaaaatatatgtttatataaagatttgtataatatttttatagtagttttatttataatattaaaaaaattggaaataatttagatatttatttatagttaaatggataaataaattatagtatataaataaaaagaataaaaagaattaattattgatatatattataatttagttgaattttaaaataattatgttgagtgagagaaattaaatgaaaaaaagatatattatattatatataattttaagaaataaaatttaatttatttggtatttagatttttatttttatattagttttaaataaaaagttttaaatttttttggataaatggttgattttacgattggggtaggaaatatataagatgagtttgatgagtttgtagtattttgtaatattagaaagtaggaaagtttatatatatatatatatatatataatatagagagtgggttaaggagtataagagttaattgaaaaagtttttagtgttaaaaattggaaaaatttgagtaataaagtatttatgaatttatataaagaaaagattgaataaagaagtaaatgggggagaagaagtaaattttttttatagaattttaaataaattatgtagatattttattttaaaggagggttagtataattttttatttttttatatttttttaagtgatttataatgatttttttttaaagagtatagagtatgtaaagagggaaaaaagagtaattatgtaatggagaaatttgataaatattattttagttaggtgatggagaataatattaatagttataagttatgttgataatatgtattttttatatgatgtaataaatatagtatattatttttttgatttttatttcgttaaaatttaaaattttagtttatttatgaggatatattaaattttaatagaagggtattttgtaatatattttattagtatttttaaggattgttaaggttattaaatataaggaaaatttgagaaatttttatagttaagaggagtataagatattataataattaaatgtggtgttttggatggaattttggaaaggaaaaaggatattaagtgaaaatgaagaaaatttaaataaattatgaatattagttaataataatttattagtattagtttattaattgtaataaatgtattttattaatttaaaatgttaatagagaaaattgtataaatgatatatgagtattttttatattatttgtttaatttttttgtaaatttaaaatcgttttttaaaagtaaaatttattaataaaatatttaaagtaaatagatttaaaaggtatatgtaaatgtataatttaatgtttaataaattagatataaatatttttaaaaatttaatatttggtgatagaaagtagattagtggtttgttagaaagtggtgattagtattaggggaaggggatgggatagaatagtatgaagggatttaaaaaatggtatgaggaaatttttggaggtaaagggtatgtttattattttagttttataggtttaataataaattatataatttaaatatatgtagtttattatatgataattatattttgataaagtggtttttttttttaaattatagaaaaaatatttttatatttaaatttttttttttaaaaatagtttttaggaatatttgaagttagttttattatatttgaatttaattagtgaattttgtttatttaaagatttatatatttgggaagtttttgtgttaaaaatgttaattatttagtattaaaatttatggaataatggtgatttaggatatgttggatatttttattgttgtttttttattttaagatttttaattttttggaaataatttttttagatattttgataagggaattattataattaattaaaattaagttaaatatagtttgttagatttaaaatgaggttaagtgttaattttatagtagcgatcggaaaattaaattatatggtatttgatatttaaaattatatttttaagaaggttgttatttgatgttttgggtttgggttatagtatttaattttataatattgggtaattttgtgttttagtttttttaattatgaaattgggataatagtatttattttgtgagattgttgaaggattatagttaatataggtaaaaggtttataagattatttggtaatgttgttttgattttataaattttatatattgtgtggtattagttattaggaaaatataaataaattagtgagatattattttatatatttggggggttataataaaaaagatagataaaaaatgttgttaaagatgtgaagaaattaggatttttatttattgttggtgnaaatgtaagaagtataattatttgaattatagtttggtagttattttaaagattatatttagagttgttatatgaattagtaattttatttttatgtatatatttaggagaaaggaaaatatacgttgtataaaaatttgtatatgaatgtttattagtaggattttttatggtagttaaaaggtgtaaataatttaaatgtttaataattgatagagatggataaataaaatgtggtttatttatataatgaaatattatttgttaataaaaaggagtgaaggagtgaagtattgatttatgtggaatatggatgaattttgatttaaaatagttaaattataggtataaaaagtatattagtggttgttgggagatttaggcggaaatgtggaataattgttagtgggtattgagattttagagttatatttatgttataaaattaatagtgttgatggttgtataattttgagtatatgaaaaattaatgaattgatattttgagtgagttgtatgatattggaattatattttaataaagtatggtaattgttttaagataggttggaaagagaaagtttgaaaataataataatgatattaataaattagtttatttttttagttttatatatttttgtgtttatatttgtttttgttttatttataatggtttttttgtagttgttatattatattttgttatttgatgttcggtgaatattttatatttgttttttagaattttttttattttttttttatttgtttaatttttatatatttaaaattaattagagtaaattatttattagaataattaattttaaattttagtaatttaatatgataaaggtttgttttttatttatatagtttttttttagatgatcgaggggtttaggttttttatttttagtggtttttttattttttggagttttttgtattttttatatatggttgagataaattatgagttattagtatagttagattttgaggttttataagaaaatttgtaaattatttattttgttttgaataaggtatatttaagatgatgttaaaatatttaatggttttgggttaaatatagtttatgattgtgtatttaaaatatatattgtaatatttttttttttttttattgattttatgaatttagcggggatttattttataagtttaaagataattattttttagattaagaatatttagggtaaaaagtattgtttaatatttttattgaggatgttatgatgtagtatattgtataagttggagttaaaggaaattttttttaaagtgttatttattaaaaattggaatatattttttaagataaatcgaagtgtggtatataatatttaaatttttattatagatatagaggtgttattattttttatttttaaatttttttgttacgttgaggatatttaagaggagtaggatatgttggtcgtagtaggagaaatttgaaagtatttatttttatggaatttataagggagagaattttttattttagtatcgtttttgatatatttattattttaaaagataatgtagttaaatgtttttttttgtgttaaatttttataaaattgaaattttaaaatggtgataaaaattttatttttgatagaatttatttatttttttaattagatagggtataatttttaatttgtaaaataaaacgtaatatgtttatgaggttttattttaaagaatttgttattgagagtagtatttagaataacgggtggaaatgttaattttagagttttagattttatcggtaattggggtagggaggggttttgggcggggtttttttagaggaggaggcgttgttagaaagttgtttggttagtttatagttgttattaatcggggtaagttttgttgtatttgtgcgtgtgggtggtatttttaatgagaattagttttatttgttatttgagtgaaatttataattcgaggcggttagtgttttcgtattattgggatttgagattttcggagatgattgtcgttcgtagtacggagttagtagaagttcgattttttttgggaatgggttgtatcgagaggttcgattagttttagggttttagtgagggggtagtggaatttagcgagggattgagagttttatagtatgtacgagtttgatgttagagaaaaagtcgggagataaaggagtcgcgtgttattaaattgtcgtcgtagtcgtagttatttaagtgtcggatttgtgagtattttgcgtttttagttttcggatagaagttggagaatttttttggagaatttttcgagttaggagacgagattttttaataattattatttttttttgcgttttttatttgtcgttcgttgggataaacgatagttatagtttttttgacgataggatggaggttaagggtaggagttgattagcgtcgttttttttcgttttcgatttaggaggtggagattttttcggtttagttatatttaatatttatttttttttttttttgtttttatattttcgaaatttttttttttttttttttttttttttttttggagacgggggaggagaaaaggggagtttagtcgttatgattgagttgaaggtaaagggttttcgggttttttacgtggcgggcggttcgttttttttcgaggtcggatttttattgttgtgtcgtttagtcgtaggttcgttttcggggagttagatttcggatattttgtttgaagtttcggttatatttatttttttggacgggttatttttttttcggttttgttagggataggattttttcgacgaaaagacgtaggattagtagtcgttgtcggacgtggagggcgtatattttagagttgaagttataaggggtgttggaggtagtagttttagttttttagaaaaggatagcggattgttggatagtgttttggatattttgttggcgtttttaggtttcgggtagagttaatttagttttttcgtttgcgaggttattagtttttggtgtttgtttggtttcgaatttttcgaagatttatcggttgttttcgttatttagcgggtgttgttttcgtttatgagtcggttcgggtgtaaggttggagatagtttcgggacggtagttgtttataaagtgttgtttcggggtttgttattagttcggtagttgttgttttcggtttttgagagtttttattggttcggggttttagtgaagtcgttttcgtaggtcgttgcggtggaggttgaggaggaggatggttttgagttcgaggagtttgcgggttcgtttttgaagggtaaatttcgggttttgggtggcgcggcggttggaggaggagtcgcggttgtttcgtcggggcggtagtaggaggcgtcgttttggtttttaaggaagattttcgttttttagcgtttagggtcgttttggtggagtaggacgcgtcgatcgttcgggacgttttcgttggttattacggtgatggattttatttacgtgtttattttgttttttaattacgttttattggtagttcgtattcggtagttgttggaagacgaaagttacgacggcggggtcggggttgttagcgtttttgtttcgtcgcggagtttattttgtgtttcgtttatttcggtcgttgtaggcgattttttcgattgcgcgtattcgttcgacgtcgagtttaaggacgacgcgtattttttttatagcgatttttagtcgttcgttttaaagataaaggaggaggaggaaggcgcggaggttttcgcgcgtttttcgcgtttttattttgtggtcggtgttaatttcgtagttttttcggatttttcgttggggttatcgttttcgttgtcgtcgcgagcgattttatttagattcggggaagcggcggtgacggtcgtattcgttagtgttttagtttcgtttgcgtttttttcggggtcgattttggagtgtattttgtataaagcggagggcgcgtcgttttagtagggttcgttcgcgtcgtcgttttgtaaggcgtcgggcgcgagcggttgtttgttttcgcgggacggtttgttttttattttcgtttttgtcgtcgtcgtcggggcggttttcgcgttttattttgtattcggttttaacgggttttcgtagttcggttattaggtcgtcgtgtttaaggagggtttgtcgtaggtttattcgttttattttaattatttgaggtgagggttcgggacggggtacgtttagcgcgttcgggagtagcggtttcgttggcggcggcggtcgttaatttttagttttagttttagcgtatcgttgcgtttttcggggcggtcggagagggtgggtagcgggatatagtataggggtagttgtttttttttttttttttttttttttttatttttggggatacgaaggtgggcgtagaatatattatttttggggcgtgtttttttgaaagttgtttttttgtttgttttttaatttttcgaattttttagatttcgaagtagaattaatttcgatttaaaacgtgtagcgttatattaggttcgttgtagtttagtggggtagaaagtgcgcggcgagttgggggttttatgaaatgttttttttttagaagaaggacgtttattaggagtgtttgttttggagaggagttaaggtatcgttttttcgggaggggtgggatttgagaggtggtcggttagaatcgaaagtagtattattttagggatttgaatattttagtggtttagtttttttaagaattttaagattaaaattaagtttacgtgggaaatgtttaaattgtggatttaaacgtttgttattgtattgtatcgtttttttattattgtttgttatttattataattttttttatatataggtttaaaaaatattattttgtatattgaagtaatggaatgtaaaaaaagaatgttttgtttggaattttatgttgtgaataggtaaaatagtgttagtgtattggataatattttaaaatgataaatatatatttgtttaagtaagtaatgattatagggttgtgttttaaaaatttaaaattaaaatattgtaaagtattatcgaatttttaaagttaaattatatttgttttgatttagtatatagataggaaggatataatattttatttgttaaagattaaattgtttttatataaagagttttgtagaaagatttttttttaatcgattttaattttttaggatataatattatatattaattattgtttttttatattggtgttattgatgaatggttaattatttgtaagtatggtgaatttagttacggatagtttattattaagtttagtttgtatgttttttaagtgtatatatatagttttgtttttaaaatttttttttattttgttaatattggtttaagaaatttttagtattagatagtggtgtatttaaaaataaatggagtattttgttttgtattttaagg

SEQ ID NO: 40 - DNA, 8085 bp, Artificial Sequence
  Chemically treated genomic DNA (Homo sapiens)
  unsure 5541: n = a, c, g, or t
ttttgaaatgtaaaataaagtattttatttatttttaagtgtattattatttaatattaaaggttttttaaattagtattaatagggtgaaaggagattttaaaaatagaattgtatatatatatttgaaagatatgtaaattaaatttggtaatagattattcgtaattggatttattatatttgtaaatgattagttatttattagtagtattaatataaaagaataataattagtgtataatattatgttttagaaagttaaagtcggttaaaaggaaatttttttataaaattttttatatagaaataatttagtttttgataaatgaaatgttatgttttttttgtttgtatgttgggttaaaataaatatggtttggttttaaaagttcgatggtattttgtaatgttttggttttgagtttttaaaatataattttgtaattattgtttatttaagtaagtatatgtttgttattttaaagtattgtttaatatattgatattgttttgtttatttataatataagattttaaatagagtattttttttttatattttattattttagtatgtaaagtagtgttttttaaatttgtatataaaaaaaattgtagtgaatagtaagtaataataagaaaacggtgtaatgtagtgataggcgtttaaatttatagtttaaatattttttacgtgaatttaattttaattttgagatttttaagaaaattgagttattgaagtgtttaaatttttaagatggtgttgttttcggttttggtcggttattttttaagttttatttttttcgggggaacggtgttttaatttttttttaagataagtatttttggtaaacgttttttttttaagaaagaagtattttataaagtttttaattcgtcgcgtattttttgttttattgggttatagcggatttagtgtgacgttgtacgttttaaatcggggttggttttgtttcggaatttggaagattcggaaagttaaaaaataaataaaaaaatagtttttagggaggtacgttttaaaaatagtatattttgcgtttattttcgtgtttttaagagtgaggagaggagggaagaagaagggaggtaattgtttttgtgttgtgtttcgttgtttatttttttcggtcgtttcggggagcgtagcggtgcgttggggttggggttgagggttggcggtcgtcgtcgttaacggaatcgttattttcggacgcgttgggcgtgtttcgtttcgggtttttattttaggtagttgagatagggcgggtagatttgcggtaggttttttttgagtacggcggtttggtagtcgagttgcgggagttcgttgaggtcgagtgtagggtagagcgcgggggtcgtttcggcggcggcggtagaggcggaggtggagggtaggtcgtttcgcgggagtaggtagtcgttcgcgttcggcgttttgtagggcggcggcgcgaacgggttttgttggggcggcgcgtttttcgttttgtataggatgtattttagggtcgatttcgaggaggacgtagacgagattgaggtattggcgggtgcggtcgttatcgtcgttttttcgggtttggatggggtcgttcgcggcggtagcgggggcggtggttttaacgggaaattcgggaaggttgcggggttggtatcggttataaggtaggaacgcggggagcgcgcggaggttttcgcgttttttttttttttttttatttttagagcgggcggttggaagtcgttatagagagggtacgcgtcgtttttgggttcggcgtcgggcgggtacgcgtagtcggggaagtcgtttatagcgatcggggtggacgaggtatagggtgaatttcgcggcggggtaaaggcgttggtagtttcggtttcgtcgtcgtaattttcgttttttagtagttgtcgagtgcgggttgttaataaggcgtgattgagaggtaggataggtacgtggatgaaatttattatcgtggtggttagcggggacgtttcggacgatcggcgcgttttgttttattagggcgattttgggcgttgagaagcgggaattttttttggggattagggcgacgttttttgttgtcgtttcggcgggatagtcgcggttttttttttagtcgtcgcgttatttagagttcgaggtttgttttttagaagcggattcgtagatttttcggatttagagttatttttttttttaatttttatcgtagcggtttgcggagacggttttattggggtttcggattagtgagggtttttagaggtcgggagtagtagttgtcgggttggtgataggtttcggggtagtattttatgggtagttgtcgtttcggagttgtttttaattttgtattcggatcggtttatgagcggggataatattcgttgggtggcgggggtagtcggtggattttcgggaagttcggggttaaataggtattaagagttggtgatttcgtaggcgggagggttgggttggttttgttcgggatttgagggcgttaatagagtgtttaagatattgtttagtagttcgttgtttttttttgggggattagaattgttgtttttagtattttttgtagttttagttttggaatatgcgttttttacgttcgatagcgattgttggttttgcgttttttcgtcggaggggttttgtttttggtagggtcgagggaagagtagttcgtttagggagataggtatggtcgaaattttaggtaaggtgttcgaggtttggtttttcgggaacggatttgcggttgggcgatatagtagtggggattcgatttcgggggagggcgggtcgttcgttacgtggggagttcggggattttttgtttttagtttagttatgacgattggatttttttttttttttttttcgtttttagggaggagggaaaagggaaggaggagggggtttcgggaatataggggtagagggaggagaaagtgggtgttgaatgtggttggatcggagggatttttattttttgggtcgggggcgggggagggcggcgttggttagtttttgtttttggtttttattttgtcgttaggggaattgtggttgtcgtttgttttagcgagcggtaagtggggagcgtaagaaaaagtagtaattgttaggagatttcgttttttaattcggggagttttttaagagagttttttaatttttgttcgaggattggagacgtagagtatttataagttcggtatttgagtggttgcggttgcgacggtaatttagtgatacgcggtttttttatttttcgattttttttttggtattaaattcgtgtatgttgtgaagtttttagtttttcgttgagttttattgtttttttattaaaattttggggttagtcggatttttcggtatagtttatttttaggaagggtcggatttttgttggtttcgtattgcgggcgatagttattttcgaagattttagattttagtagtgcgggagtattagtcgtttcgggttgtagattttatttaaatgataagtgaagttagtttttattgagaatgttatttatacgtataaatataataaggtttatttcgattagtgatagttgtggattggttagatagttttttaataacgtttttttttttagggaggtttcgtttaaagtttttttttattttaattatcggtaggatttgaaattttggagttggtatttttattcgttattttgaatgttatttttaatagtaggttttttgggatggaattttataagtatattacgttttgttttgtaaattaagaattatgttttatttaattggaaaaatgaatagattttattagaagtagaatttttgttattattttaagattttagttttgtaaagatttaatatagaggaagatatttggttatattattttttaaaataataaatgtattaaggacgatattaaaataagaaatttttttttttatgagttttataaaagtgaatgtttttaagttttttttgttgcgattaatatgttttgttttttttgagtatttttagcgtgataaagaaatttgggagtgggagatggtaatatttttgtatttatgatggaagtttggatgttgtgtgttatatttcgatttgttttaaggaatgtgttttaatttttagtaaatagtattttaaggaaagttttttttagttttagtttatatagtgtgttatattataatatttttagtagagatgttgaatagtattttttattttaaatatttttagtttgaaaagtaattatttttgagtttataaaatggattttcgttaaatttatgaagttagtagaaaaagggaagaatattgtaatatatattttagatatatagttataaattgtatttgatttaagattattgggtattttaatattattttaaatatattttgtttaaaatagagtgaatgatttgtaaatttttttgtaggattttaaggtttagttgtgttaatgatttatagtttattttaattatgtataaagaatgtagaagattttagaaggtgggggagttattagaggtaaggagtttggatttttcgattatttggggaggggttatatgagtgagaaataaatttttattatgttaggttattaggatttggagttggttgttttagtaaatagtttattttgattaattttagatatgtggaagttaggtagatagaggaaaggtaaagagaattttgggaagtaggtatagaatgtttatcgggtattaaatggtaggatataatatggtaattgtaaggggattattatgaatagaataggagtaagtgtgggtatagaagtatatgagattagagaagtaaattaatttattaatattattattgttgtttttaggttttttttttttagtttattttaaaatagttattatgttttattgaggtgtaattttagtattatatagtttatttaaagtattagtttattgattttttatgtatttagagttgtgtaattattagtattattaattttgtaatatgagtatgattttaaaattttaatatttattagtagttattttatattttcgtttaaattttttagtagttattaatatgttttttgtatttgtgatttggttattttggattaaggtttatttatgttttatatgaattagtattttatttttttatttttttttattgataaataatattttattgtatggataaattatattttatttatttatttttattagttgttggatatttgggttgtttatattttttggttattatgaaaaattttgttaatgaatatttatgtataagtttttgtgtagcgtatattttttttttttttggatatatgtataggagtggaattgttggtttatatggtaattttaggtgtggtttttggagtaattgttagattatggtttaaatgattgtattttttatatttntattagtagtgaataagggttttagtttttttatatttttgataatattttttatttgttttttttgttatagttttttaagtgtgtgaagtggtattttattgatttatttatatttttttgatggttaatgttatatagtgtatagaatttgtaaaattaggatagtattgttaggtagttttgtaagttttttatttgtgttaattgtaattttttaatagttttataaaataggtattgttattttaattttatagttgggaaaattgaggtataaggttatttagtattataaagttaagtattgtaatttaaatttaagatattaaatgatagtttttttaggagtgtgattttaaatgttagatgttatataatttgatttttcggtcgttgttgtaaaattggtatttggttttattttaaatttgataaattatatttggtttgattttggttggttataataatttttttgttagaatgtttggggaggttgtttttaaaagattgaaaattttgaagtgggaaaataataataaagatgtttagtatgttttaaattattattattttataaattttgatgttgggtgattagtatttttggtataggaattttttaaatgtatgaatttttgaatgaataaaatttattgattaaatttaggtgtgatggggttaattttaaatatttttgaagattgtttttggagaagaggatttaaatgtggaagtattttttttatagtttggggaaaaaaattattttattaagatatagttgttatataataagttgtatatatttaaattgtataatttgttgttagatttgtgaaattaaaatgataaatatattttttgtttttaaaagtttttttatgttattttttaaatttttttatattgttttgttttattttttttttttagtattaattattattttttggtaagttattaatttgttttttgttattaaatattaggtttttaaaaatatttatatttgatttattaaatattaaattatatatttgtatatgttttttaggtttgtttgttttagatgttttattaatagattttatttttgggaaacgattttggatttatagaaaaattgagtagataatatagagaatgtttatatattatttgtataattttttttgttagtattttaaattaatagggtatatttgttataattaatgaattaatattgataaattgttattaattaatatttatagtttatttagattttttttatttttatttaatgtttttttttttttttaggattttatttaggatattatatttaattgttatgatgttttgtgttttttttggttgtgagagttttttagattttttttgtatttgatgattttgatagtttttaggagtattggtgaggtatattgtaagatgtttttttattgggatttgatgtatttttatgagtagattagggttttgggttttggcggggtggaaattaaagaggtaatgtattgtatttattatattatatgaagggtatatattgttaatatgatttatgattgttaatgttgttttttattatttggttgaagtagtgtttgttaggtttttttattgtatagttatttttttttttttttttgtatattttgtattttttggaaggaaattattatgagttatttaaggaagtgtgggggagtagggagttatgttagtttttttttggagtggagtatttatataatttatttggaattttgtgaggaagatttgtttttttttttttatttatttttttatttagttttttttttgtatggatttatgaatattttgttgtttaaatttttttagtttttggtattgggggtttttttagttgatttttgtgttttttgatttattttttgtattgtgtgtatgtgtgtgtatgtgtggatttttttattttttggtattataagatgttatagatttattagatttattttgtatattttttgttttagtcgtagaattagttatttatttaaggaagtttgagattttttatttgaaattggtatagaaatgaagatttgggtgttaaataaattaggttttattttttagaattgtatataatatagtgtattttttttttatttggttttttttatttagtataattattttgagatttagttaaattatagtatgtattaatagttaattttttttattttttttatttatatattatagtttgtttatttatttaattgtggataaatatttgagttgtttttaatttttttggtattataaatagagttattatgaaaatgttgtataagtttttgtatgaatatgtgtttttattttttttgggtaaatatttagtagtgaaatggttggataaattagtaggtgttgtgatatgagtgtttgtgttttttttaaatttgtgtgttaaaatttaattattaatgtgatagttttagtaggaggaggtgttggggagtgattaggttatggagt

SEQ ID NO: 41 - DNA, 5118 bp, Artificial Sequence
  Chemically treated genomic DNA (Homo sapiens)
aagtgtaggatggtttgtttttgaaatatatttggtttaaatgtttattatgggagagagaaatagataggagttgaagaaaggagcggggttttgttgttttttgtttatggagtacgtagggcgggcggatgaaggtcggagttagtcgaggttgggattgagtattaagattggtttgggatggatttgatttttggttaatagaggagataaggggtcggttgggagtgtgatttagaaagaggtagaggagcgtgtgaagatggggttaaagtatttggaaggttggttggggaatgaggcgatagaaattattaataggggaggtggcgtttatagggatggtttattgtttttgagatggaggttttggggtttttggggtggatatagttgtggacgttttttggaagagttaggggtagtagtgataaagatataattagagggtttttaattagtattttttttaaaagatgttttttttttttttttagatttattttagttagtttatattttggtggtaaggtttttttttgtttttattatatagaattattaatttttaatattaggttttttaagttgtttgttcgggttaggggagtattgtagggagaggttgaaatagtgttttttttgggattttttggttgttttattgttttatttttattttcgttatttttatttaaatttagaggttttaatagatagttaaggtttagtagtttaggagttggagttggataatttgaggagtaagttaataaggttaattttgttatgtttatttttgttttttaggagaaggatatgattttttttatattttatttaaaaattaaaattaattttttggtgtaaagtttatgttttttttgaaattaggtggaatagtaagaagatttgtaggatagggatatggaattaggttattgtatattggtgaataaattgtgtatattatataaatttaaaagatattatttataggatagatgttgtagatagggatgtttgttatgatatttttttaatagatgatagtaaaggttgttgtagaaattttttagtagatgatagtaaaggttgttatggatagaatatttttttttaatttttttaaaaatatgggagggttagtagtagtttagtgatagtttgggttttttttttttaaggtttagatttagagttttattttattttttttaaagtttattttttttttagttttttttcgtgtgtttagatttgttatggtgggtttatttattttttttgggaagagataggatagatagggatttatgggatgagggtaatacgagataggtggggaatttttttttggagattaaagatatttttttttattattttatttttataagagttatttggttagaagggatatcgagttggatttttttataaggattgggaggttggttttggaggtcggcgaagagataaggaggttgtagtcgagagatttgtgttttttagtaagatttaaggtaagagattagagttttaatgaggttgagtttgtttttgattatttttttttttttttaattgttttttatgatttttgattttttatttttttgtaatttagtatttggtttgtggttgggtgtttttgggtttgtaggtcggatgggattggggtttttaggatagttaaaagagattagggattcgtttttttttgttattttttggagagaaaaatagtaatttttgggttttttttttttttttgttttagttttttttaggaatttattattttagtttaagtttttttagattttttatcgggttgagtgttttatattatgtagaggtagttaggttggggatgatagaaataattgttttgttttttgttgtagatttggggtataaggagggaggttatggggaagttgaaataagggtaagatgagaggtattaggtaaggaaagaggataaaatgtagataaaagagatgatgggatttgtgtttagattagaaatggtagatgtgttaaatagattaggataattaggtttggttaaaaattatttgttattgaattatttggggtagattttggattttagaaatatggaggttggatttaggaatgtgtatttttaaaaagttttttggttaattatgaagtatattgaaattggagatttattgattttagaaaaaggggttttagatttaaggatgaaaggttggaggtttaaagtttattattttagttattaagtgttttggtgtttggatatagaagggagttttacggagaaatgttatatttgaaagagtagtttttaaagtaaaaatatttttagttttttttgttttgtttttatacgtattgtaggtatattgggttgtaatttgtttagtatttttttaggttgggatggataggagtataggtatagatgaataaggttaagttagattttattgtgaggagggtgaaggaggtttggatttaatgcgggttaaaggttagggttaaaagttatttacgttattttttggagttttaggtaagtttagtagtttttagtgtttcgtgtattcgagttttacggttcgaaggggtaggtttaggggatttggagggggtagtattacggggaaaggttaaaagttaggggttaaagtttattttatatcggttatttcgttttatttttttttttttttttttattaagtcgttttgtttttattattttggagttatagtagttgtttggtagttcggaagtgcggtaagtagtcgttgcgaagtaagtttcgtttcggaacgggcggaagtagaggtaattttcggtatagtttcgtcgagagcgtgaattatcgttgcggaggggtagatttggatcggtggaaggtcgggcggaagtgcgcgtttggggtcgttttggttatcgcgtttttcgtttttcgttacgttatcgttgtgagttcgttattagcggttagcgcgggcgcggtcggagatcgtggggttttcggttgtcgttttttcgggtaaggttttttgttttttatttttcggtttttttttttatagtcgtttttttgttttttttttttgcgttgttttgcgggcgttacgttggttttatcgttttttttgtcgtttaaatttcgcggttgtttttattttagcgagggtaggggggtcgggtgttatcgttttttcgacggagtggatatttgtttttttttgaattatatggtatttaaaggtgttggtgtttgtgatttttggagataggagggaatgttggatgatttcgattagcgggagtttggatagtagtttggtttaagtaaggggtagggaaagttaaagataagagtaggtagatttgaaggggtggggttgggtatagtgtggacggcgtgtgaatttcgggtggtaatagtggagaaagatgttttgggttttgtttttgaattaggagttattatgttggtgatatttttcggattgagcgaggaagaggaggttttgtagaagaaatttaataagtttaagaaaaaggtgagggattgtgtgtggatatggtttaattttttatagattttgtattttgagaagatatggggtgagtgtgagcgaatggggaagtttttttggtttatatttagagatatattattttatagtgtagtttcgagaggtgggtttttttaagttttggtgtggattttttgttttttttatgtaatttgttatggattgttttttttttttatggtttttagtatcgtttaagagttgatgatttttaagtttgttttttttagttttatttagtgttatattgaaaaattttagatatttagtgttgaagttattatttttttatttttgattttttaaataagattgattatattaattttgttatatgtttggatttaaaattttgatttttttattatttgtatagttaaatttttgttaagttttattgtttttttttttgaagtaattttttttgtttattttttattgtgtattttttcgagtagggttttattgatatttatgtgggttattgtaatggttttttaataaattttttagtttttttttttgaatagatttttttatttttgtttaaatgatttattgaaaatataaaattttgttttttttgttttttaaaaattataaatggttttatattgtttataaaaaagttttaaaattttagtttggtagttttgtttagtaaagtagaattatttattatttttaaaagatgtatttttaaagtttttttatttttgtatttttgttattttgttttttttttttaaaatattttttttttttttgtgttgtgtagagatacgggagagggtttagtttaatagttattaaatattagaaaattttattagtttttagttatgaataatttgtattttttataattgtattgttaatttaatgtattttattttttagattgtaagttttttgagggtaggaataatgtattagttttttggatatttttgttacgaagttatggttgggttttatttaatatgtaggaaatagatggatgaagtttttaggaaaggtatataaatttatatttatttgtagtttatattttaggattttagtttatgattgagttatttgtttttaattttaaaaatgtaatattttggaaaatttttgggtttcgtggtttggttagattaggaatttttagtattatatatgatttaggggattagaggtaagaggtagagtatattagtgtattattttgagggtattaagaaagatggtttttggagtgatgtgtttaggggttttaggagaggaatcggttaggggttggtttttatttatttttttttttttatttttgtttttagaaaaaggtattgttggttttgaagaagtaaagtagtagtagtataattagttaaggtggtgttaaacgttgtgagtgataggggaaatggggatggattggaagtgggtagtatggagttgatttttattatggtttggttaatataatgttttttttttttgtttttttagt

SEQ ID NO: 42 - DNA, 5118 bp, Artificial Sequence
  Chemically treated genomic DNA (Homo sapiens)
gttggagagataaggggaagaggtattatgttggttaagttatgatgaaggttagttttatgttgtttatttttagtttatttttattttttttgttatttatagcgtttgatattattttggttggttgtgttgttgttattttgtttttttagagttagtaatgtttttttttgggaataagggtgagaagagagaggtaagtgagggttagtttttagtcggttttttttttaaggtttttgggtatattattttagggattattttttttgatgtttttagagtggtatattgatgtgttttgttttttgtttttggttttttagattatgtatgatgttggaaatttttaatttaattaaattacggaatttagaggttttttagagtgttatatttttgaagttgaagataaataatttaattatggattagaattttaggatataagttgtaagtaagtataagtttatgtgttttttttggaagttttatttatttattttttgtatattgaatgaggtttagttatgatttcgtaatagggatatttaggaggttaatgtattgtttttatttttaagaagtttatagtttgagaaataaaatatattgagttagtaatataattataagaggtgtagattatttatagttgaaagttagtaagattttttgatgtttaatggttattaaattaggttttttttcgtatttttgtataatatagagaggagaagggtattttagaaaaagaaaatagggtggtaaagatgtagagataagaaggttttgggaatgtattttttggaagtagtgaatagttttattttattagataaggttgttaaattaaggttttgaggtttttttatagataatgtgaagttatttatggtttttgagaaatagagggagtagaattttgtgtttttaatggattatttgaataggagtgaagaagtttgtttaaaaaaaaagattgagaaatttgttgagagattattataatggtttatatgaatgttaataaagttttgttcgggggaatgtatagtgaagaataaataggaaaaattattttaaaagaagaaataataagatttggtaaaggtttgattatgtaaatagtggggaagttagagttttgagtttaaatatgtggtagaattggtgtagttaattttatttggaagattaagaatagaaagatgatagttttaatattgagtatttgaagttttttagtataatattggatagaattggaaaaaataaatttggggattattagtttttaagcggtattaaaagttatgggaaaggaagataatttatggtaaattgtatagaaaagatagaaggtttatattaaggtttgggaaagtttatttttcgaagttatattgtgaggtgatatgtttttaggtatgggttagaaaaatttttttattcgtttatatttattttatatttttttagagtgtagagtttgtgaaaggttaggttatgtttatatatagttttttattttttttttgagtttgttgaattttttttgtagagttttttttttttcgtttagttcggggggtattattaatatggtggtttttagtttaggggtagggtttaagatatttttttttattgttattattcggggtttatacgtcgtttatattgtatttaattttatttttttaggtttgtttatttttgtttttggttttttttattttttgtttaaattaggttgttgtttaagttttcgttggtcgggattatttagtatttttttttgtttttagggattatagatattagtatttttaggtattatgtggtttaaggagggataaatatttatttcgtcggaaagacgatggtattcgatttttttattttcgttagggtaaggataatcgcggggtttgaacggtagagaaggcggtggagttagcgtagcgttcgtagagtaacgtaaagaggaagaatagagaaacggttatgagaaaaagggtcgaagagtgagaagtagagggttttattcgagggggcggtaatcgggggttttacggttttcggtcgcgttcgcgttggtcgttgatagcgggtttataacgatgacgtagcgaggagcggaaaacgcggtaattaaggcggttttaggcgcgtattttcgttcggttttttatcggtttaggtttgttttttcgtagcgatagtttacgttttcggcggggttgtatcggaagttgtttttattttcgttcgtttcggggcggggtttatttcgtagcgattatttgtcgtattttcgggttgttaggtagttgttgtggttttaggatgatggagatagagcgatttggtgagggggaggggagggaaatggaacggagtagtcgatatggaatgaattttgatttttgatttttgattttttttcgtagtgttattttttttagattttttggatttattttttcgggtcgtggagttcggatgtacggggtattgggagttgttgaatttgtttggagttttagagagtagcgtgagtgatttttgattttaatttttgattcgtattgagtttaaattttttttattttttttatagtaggatttagtttaattttgtttatttgtgtttgtatttttgtttattttagtttgaaggggtgttggatagattatagtttagtgtatttgtagtacgtgtgaggatagagtagaaagggttggggatatttttgttttgagagttgtttttttaaatgtggtattttttcgtggagtttttttttgtatttaagtattagggtatttggtgattgagatgataggttttgagtttttaattttttatttttaggtttgggatttttttttttaaaattagtgagtttttaattttagtgtgttttatgattagttagggagttttttaaaaatgtatatttttaggtttagtttttatgtttttgaaatttaaaatttgttttaggtaatttagtagtaggtagtttttggttaagtttgattgttttagtttgtttgatatatttgttatttttgatttgaatataagttttattattttttttgtttgtattttattttttttttttatttaatgttttttattttgtttttgttttagtttttttatggtttttttttttgtgttttagatttgtagtaagaagtagaatagttgtttttgttatttttagtttggttgtttttgtatggtgtggagtatttagttcggtgaggagtttggaggggtttagattagggtgatgggtttttgaaggaagttgggatagaggaagaaagaagatttaaaagttattatttttttttttagaaaatggtagaggaagacggatttttggttttttttggttgttttgggagttttagttttattcgatttataggtttaaagatatttaattataggttagatattgggttataaagaggtaggaggttaggggttatgagaaatagttggggagaaggggaggtggttagagataagtttagttttattggggttttgattttttgttttaggttttgttggagaatataaatttttcggttataatttttttgttttttcgtcggtttttagggttagttttttagtttttatggggaaatttaattcggtattttttttggttaggtgatttttgtggagatgggatggtagaagagggtgtttttaatttttagggaagggttttttatttatttcgtattatttttattttatgaatttttgtttgttttgtttttttttaggggggatggatgaatttattataatagatttgaatatacgggaggaggttgaggaggagatagattttgagaaaggtaaggtggggttttgagtttgagttttgaggaggaagagtttaggttattattgggttattgttagtttttttatgtttttgagaaaattagaaaaagatattttgtttataataatttttattgttatttgttgggaaatttttataataatttttattgttatttgttgggaaagtgttatagtaaatatttttatttatagtatttgttttgtaaatggtattttttaggtttatataatgtatataatttgtttattagtgtgtagtgatttgattttatgtttttattttatagatttttttattattttatttggttttaagaaaggtatggattttgtattaaaaggttagttttagtttttgagtggggtgtaggagaagttatgttttttttttaaggaatagagatggatatgataaggttgattttgttggtttgttttttagattgtttaattttagtttttggattattaagttttagttgtttgttggagtttttggatttgggtgggggtgacgaggatgagaatgaggtagtgggatagttaggaggttttagaggggatattgttttagtttttttttgtagtgtttttttggttcgagtaagtagtttggaagatttagtgttgaaggttggtggttttgtgtagtggaggtaagaaagagttttgttattaggatgtgggttggttaggatgggtttgaggggaagaaagggatattttttgggaggagtgttaattgagagttttttggttgtatttttattattgttatttttgatttttttaggaagcgtttatagttgtatttattttagaggttttagagtttttattttaggagtagtgggttatttttgtggacgttattttttttgttggtgatttttatcgttttattttttagttagttttttaggtattttggttttatttttatacgtttttttatttttttttgggttatatttttagtcgattttttgttttttttattggttagaggttagatttattttaggttagttttggtatttagttttagtttcggttggtttcggtttttattcgttcgttttgcgtgttttatgagtaggaggtagtaaggtttcgtttttttttttagtttttgtttattttttttttttatagtgggtatttgagttagatgtgttttagaaataggttattttgtattt

SEQ ID NO: 43 - DNA, 6074 bp, Artificial Sequence
  Chemically treated genomic DNA (Homo sapiens)
ttttagttttttatagttttttgatttttttttttttgattttttatatttttttttttttattttttttttgtttttgttaattattattattttatttttattaatattattaagtgtatttgtttgagtatttttgggtgtttgatttaggatttttttaggggtatttttgttggggtaatttttttagtttttagaagggtatggttgtgtggttgagattgttgaggaaagtagtaaagataggaggatagaattgaatgtaaagttattttgtttttaagtacgtttaatggaatggttttatagtagttgcgtttaattttgtgggtattgttattgtattttgtcgtttaggaagtttataaattatataatgttttttacgtggtagttatttggtggttttgagttttagagattttgatttagtattttgattaggatatggagttgtttggattattagtggaatattaatttttatattttaatattgggttttagagttattttgtgaaattttttttggaaaggaaagatttgagttttaattttaattttaatgtgtattttaaacgtaggtttgagagttgggggatggtagatgttaagtagaaggttagattaatttttggataatattggtaacgaaaattacgtaggtagttgagaataaagtaaatgttttttatttttttttatttcgtttattatgttggtgatgaaaattgtaaaaatgagtttagtataaggttttttatttttttttttggtaagagataaggaatatattaatagttaaggttttagagggagttgatatttagataatagatttttttttttaaattttttaatatattaaaatttttttattttttttaaatatagttttttagagtttttaataaaattttttttttttttttttatatatagatgatattttttttttgttttttttttgtattaggtgttttattttgttttttttttgagtttggttgtttgttgttgttatttaggaaggttttgtagttatttgaattagtttagttattgttttttggggtttgattgtgggaattgtaatttttttaatgttgggtttatggttgtgtttttttttaaagaatgtttgggttgtttaatttttagtattttgggtaattgttgatttaaaatagtaagtttagttggtttgaattatttagggaaggttttggtgtttatagttttataattatttttataaatgaattaggaaggaaggggaggttgattatagtgaagaagagggttttttaaatatattttttataataagtatgtaggagaaaggaaagggaaaattgatagggcggtttatcggtttttagtagagtataatatagtttttttgtttgtatagggaggagaggttgtgattggttttttatagaagagattatattgagtttaaggttagttgtagtaagtgtgtgtaaaggtagtttaggtagatttttagtgggaaggttatataattattaggttttacgtgtagagaaataggagttgtagtggttacgcgagatagatgtagtgtttgtaggtgaaggcgtatatttgagtttttatatagttttaaggggttatagttggaattttattcggtttagagagtgaggtgttttaatataaaatgttatattattttttaggaaaaatgattgttttgttttaaatcgcgttttgttaattttttttttattttttttatattatagttgagaaataattttatattttttgatttatttatgaaaatattttttataggaagaggtatgtacgtgtatgtatatgtatatgtttaagtaaagaagttgatatgaaaatgataatataaagatagtggtaaggaattaagataagggaaaggtgtgtttattgagggagtttttttttaaataataggtagttttgttgatgttaaatattatgttaagtatgtaaataaatttttgtatttagtatttatattaatttaatgagttaagtattatttttattgaaaatgtggaaatcgaggtagtatagtagagaagttagtatataagttttagaattagtttgttttgtttttaaaattaagttttgttttttattggttgtgtaattttgggtaagttattaaatttatttagttttgattttttttttataaaaggggatgggatttattttataagattattgtgaggattaaatgagatatataaaatataaaagatagagtattaataatttaggatattaggttttttttatgattaaacgtttaaaaattattttaatttagtttattaaaaaaatgatttttaagttaaaaaaaaaaaaaaaaatatttagtttttgatgatttgtttgatttgaatgaattggagggttataaaattatagatatggattagtttttgaaaattttggagggagaattaatgatttttaagtattagaatgtattttgatttggatattttttagtttgtaagatggtaagttatttttttttttttttttttttttttttttttttttttgagacggagtttcgttttgtcgtttaggttggagtgtagtggcgggatttcggtttattgtaagtttcgtttttcgggtttacgttatttttttgttttagttttttaagtagttgggattataggcgttcgttattacgttcggttaattttttttgtatttttagtagagacggggttttatcgttttagtcgggatggtttcgattttttgatttcgtgattcgttcgtttcggttttttaaagtgttgggattataggcgtgagttatcgcgttcggttattttttttttttttttttttttttttttgagatagagttttgttttgttatttaggttggagtgtagtggtataattttggtttattgtaatttttgttttttaggtttaagtgattttcgtgttttagttttttaagtagttgggattatagacgtacgttattatgtttggttaattttttgtatgtttagtagaaatggggggttttattatgttgtttaggttggtttcgaatttttgagtttaagtaatttatttattttagttttttaaagtgatggtattataggtgtgagttattatgtttggtttgtaagttattttttgatttaaaatattttttaattatgaaggaaattgatttgattttgttatttttttttatttttgattttgggggtaggggatagataagtagaaattgttgaatatgatttttagtcggttgggtagttattttttagttatagtgagtttgatttgcgtgttttagtaggaagtaaggagttaggtttttttttagttttggggaataggagaagggtgggggaatttttgatttttttttttttgtagttaaagtagattagtttagggaggagatagggaaattattagagtaggttaagattaatttgaaggaagtgggagttagggataatttattaaaggaagtgtatgtgtgttttgtatatgtatggggtggattaaggaaaagatttattttaaaagaataaagtatgtttcgataaatttattgaaaggaatgatttatattggtgttttttgtttaaatgttgagattaatggtttggtgttttttttttgaaattaggttgttttatttatatgaaataaattgggtagaggttaatcgtgagagtttgagtttttttaagtaaatagtaaaagattttttaggtttaatagtttttatttttatttttaaggaaagtggatttattcggagtacgtaggttagaggaggtaggagaagagggttagttcgtgagtttcgggtatttggagaatatgaatttttcgggtgtattgtttttatgagggttatcgaggaatttatggattttttatttttcgtttagaatgttttttttttattttttttatttttttaaattttagtattaggggttattttagagttataaattttgaaaggattatttaggtgattcgggtttatatatttttttttcggggtatatttggtggtaggttagtaggtttttggttttagttggtggtgttatataattagattcgttatagagatttattttttattagttttaggttagaagtacgaagattgattttaacgatgtggtttgtttgggaggtaaggcggtaggcgttgttagaattgatgggaattgtggtataggtgggaaatttggtttaataaattttttattgatttaggggattattttttttgagttaagttttggtaagcggtcggcgaaatttataggttttttttttggttgcgtttttagtttttagtttttttcgttttagagatgttttaggagcggtttttcggtgtaggtaacgggtgttcgggcggtttcgtttcgtcgtttagagtttggaagtcgttattgcggtttaggataattcggttacgcggtcggcgtcgatttcgtacgttggagttcgttgtcgtacggcgttggtagtcgggggtggtgtttgaagttaggcgttttttgttttttcgtcggttcgggtgttcggttcgcgtcgttaggttttgggattttaggtcgtttcgtttagtagttcgcgttttgttcggtgcgtttagcgttttcgttttttattttaaatttttattttttgtgtttttaggggggtatttttatcggggcgggaggggggggttagttgtgtttcggtcgtcgagtggcgaggaggtgacggtagtcgtttttttattttcgttcggcgggtagcgttgcggggcgagtgttagtagagaggcgttcggtttttttttcgttttttcgcgtcgggggtaggttttgtttagtttgcgtttttttttttcgtatcgcggcgtcgtttcgttattcgggtatcgtaggtagggtaggaggttggagagtttgttgttcgttcgttcgtaaaatggttttttcggttggatagttcgttttgttcgttttgggtacgtacgtcggttgcggcgttttttgcgtcgcgcgatattttgtttttttcggttttcgtcgagttttttttttcgggggtttttgcgttcgtttgggagagtggagagaagcgagtagttttaatgggttggcgtttgggaggtaaggggagttattaagaatgataaagaggggattgttcggtcgagcgtcgaggttttttcgggaaagtggttgtttgggtcgtgcgtgagaatatttgggaaggggaagcggagtgtgaacgggtttgaattttaattcgtcgtagttgtgtgtttgtttagatatatgtttatatttatttgtttatttggttgtttttaagttcggtttagtcggcgtcgttggcgtgtagattgggtcgtttcggaacgggggtcggcgtttaattttttggtcgggttttgtttgcgtttttttggtattttttgtttatttttaagttttagcgacgagtagagatgtttaagatcggtagaggcgttttcgatttttttttagagtttttgagttttgggggtaggttttggatttttgggcggattaatggtttttttaattaatttttttgggagaagtggtttcggtgttcgtcgagggtaggagcgaaattttagatcgagtgttgttagttttttttgagtatgtttttggaaatgaaggagggatgggaaaggtgaggggaagttaaatttttttttcgggtcgggtttgcggagcggtgcgttttttggcggtgaagtttaagggtttgtttggacgcggtgagggcgtagcgtcgcgcgttttttggttaatttttgttttttgtgttggtgggtttttttggtgttgagatagttgattaatagcgtaggtgttttggttattgttagtttttcgtgaagtgaattgttcgttcgatatgtttcgagtttaattcgtatagtatgcggttcgttgtagggtggttagagtttgtggaaagttatggaattt

SEQ ID NO: 44 - DNA, 6074 bp, Artificial Sequence
  Chemically treated genomic DNA (Homo sapiens)
gagttttatggttttttatagattttaattattttgtagcgagtcgtatgttatacgggttaaattcggggtatatcgaacgaataatttattttacggaagattagtaataattaggatatttgcgttattgattagttattttaatattagagagatttattagtataaggggtaagaattggttaggaggcgcgcggcgttgcgtttttatcgcgtttagatagatttttgaattttatcgttaaaaaacgtatcgtttcgtagattcgattcgggagaggggtttaatttttttttattttttttattttttttttatttttaaggatatatttaaaggaaattggtaatattcggtttagggtttcgtttttgttttcggcggatatcgaaattattttttttagggaagttaattaaaggaattattaattcgtttaaaaatttaaaatttatttttaaagtttaagagttttgaaaagagatcgagggcgtttttgtcgattttgaatatttttgttcgtcgttggggtttagaggtgggtagggggtgttaaaggggcgtaggtaagattcggttagagggttagacgtcggttttcgtttcgaggcggtttagtttatacgttagcgacgtcggttgagtcgggtttggaggtagttaggtaagtaggtaggtgtaggtatgtgtttgagtagatatatagttgcggcggattaaagtttaagttcgtttatatttcgttttttttttttaggtgtttttacgtacggtttaggtagttattttttcggggaagtttcggcgttcgatcggatagttttttttttgttatttttaatgattttttttgttttttaggcgttaatttattgagattattcgtttttttttatttttttaggcgggcgtagaaattttcggaaaggggaattcggcggggatcgggggaagtagggtgtcgcgcggcgtagggggcgtcgtagtcggcgtacgtatttagagcgaatagggcgagttgtttagtcgaggggattattttacgggcgggcgggtagtaggttttttagttttttgttttatttgcggtgttcgagtggcggagcggcgtcgcggtgcgggggaaaaagacgtagattaggtagggtttgttttcggcgcgggagggcggagggaggatcgagcgtttttttgttggtattcgtttcgtagcgttgttcgtcgggcggaaataggaaggcggttatcgttattttttcgttattcggcgatcggggtatagttgatttttttttttcgtttcgatgggggtgtttttttgagggtatagagggtgggggtttggggtaaggggcggggacgttgagcgtatcgagtagggcgcgggttgttgggcggggcgatttgggattttagagtttggcggcgcgagtcgggtattcgggtcgacgaaaaggtaggaagcgtttgattttagatattattttcgattgttagcgtcgtgcggtagcggattttagcgtgcggggtcggcgtcggtcgcgtagtcggattgttttgggtcgtagtggcggtttttaggttttaggcggcggagcggagtcgttcgggtattcgttatttatatcgaggggtcgtttttggggtatttttggggcggggaaggttggaggttggggacgtagttaggaaagggatttgtgagtttcgtcggtcgtttgttaagatttggtttaaggaaagtggttttttgaattaatgaagaatttgttaaattaggttttttatttgtgttatagtttttattaattttggtaacgtttgtcgttttattttttaggtaggttatatcgttaagattagttttcgtatttttggtttgggattgataaaaaatgggtttttgtgacgaatttggttatatggtattattagttgaggttaaaagtttgttagtttgttattaagtgtatttcgaaagaggggtgtgtgggttcgagttatttgggtggtttttttaggatttgtggttttgaggtggtttttggtgttggaatttggggaggtggaggggatagagggaagatattttgggcgaagagtggaagatttataggtttttcggtgatttttatggggatagtatattcgggagatttatgttttttaggtattcggagtttacggattgattttttttttttgttttttttggtttacgtgtttcgggtagatttattttttttgaaggtgggggtgggggttgttgggtttggggaattttttgttgtttatttggggaggtttaggtttttacggttgatttttgtttagtttgttttatgtaagtagagtaatttagttttaagaaggaagtattaggttattggttttaatatttgggtaggaagtattagtgtaaattattttttttaatagatttgtcggagtatattttgtttttttagggtaaattttttttttggtttattttatgtatgtataaggtatatatgtattttttttagtaggttgtttttgatttttattttttttaggttgattttgatttgttttggtggtttttttgttttttttttaaattagtttgttttggttatagaaggggaggaattaggggtttttttattttttttttgttttttaggattagagaaggatttgattttttgttttttattggaatacgtaaattaagtttattgtggttgagggatggttgtttagtcggttgagggttatgtttagtagtttttgtttatttgttttttatttttaaagttagaggtggagggaagtagtagaattaagttaattttttttatgattggaaaatattttaaattaagaggtaatttgtaggttaggtatggtggtttatatttgtaatattattattttgggaggttgaggtgggtggattgtttgagtttaggagttcgagattagtttgggtaatatggtaaaattttttatttttattaaatatataaaaaattagttagatatggtggcgtgcgtttgtagttttagttatttgggaggttgaggtacgagaattatttgaatttgggaggtagaggttgtagtgagttaagattgtgttattgtattttagtttggatgatagaataagattttgttttaaaaaaaaaaaaaaaagaaaaaaagagatggtcgggcgcggtggtttacgtttgtaattttagtattttgggaggtcgaggcgggcggattacgaggttaggagatcgagattatttcggttaaaacggtgaaatttcgtttttattaaaaatataaaaaaaattagtcgggcgtagtggcgggcgtttgtagttttagttatttgggaggttgaggtaggagaatggcgtgaattcgggaggcggagtttgtagtgagtcgagatttcgttattgtattttagtttgggcgatagagcgagatttcgttttaaaaaaaaaaaaaaaaaaaaaaaaagaaaaaaagagataatttgttattttataaattaaagagtatttaaattaaagtatattttaatgtttgaaaattattaattttttttttaagatttttaaaagttggtttatatttgtggttttataattttttaatttatttaagttaaataggttattaggggttgggtgtttttttttttttttttaatttaaagattatttttttggtaaattgaattgaaatgatttttaaacgtttagttatagaggaaatttaatattttaaattgttgatgttttattttttgtattttatatattttatttaatttttataataattttatgagatagattttatttttttttataagagaagaattaagattgagtgaatttagtaatttatttagaattatatagttaataaagggtagagtttgattttgaaagtagaataagttggttttgaggtttatgtgttggtttttttgttatattgtttcggtttttatatttttaataaggataatgtttaatttattgggttgatgtgagtattaaatgtaagaatttatttgtatatttagtataatatttgatattaataaaattatttattatttaaaggaaaatttttttagtggatatattttttttttgttttagttttttattattatttttatgttattatttttatattagtttttttgtttgagtatatgtatgtatatgtacgtgtatatttttttttatgggaaatatttttataggtgaattaggaggtatgaagttgttttttagttgtggtgtgaaagaaataagaaaaaaattgatagaacgcgatttagagtaaagtaattattttttttaaagggtggtgtgatattttgtattggaatattttattttttgagtcgagtgaaattttaattgtagttttttgaagttgtgtggagatttaggtatgcgtttttatttatagatattgtatttgtttcgcgtggttattgtagtttttgtttttttgtacgtggagtttgatgattatgtggtttttttattaagagtttgtttggattgtttttgtatatatttgttgtagttggttttgagtttagtataattttttttgtgagaagttaattatagttttttttttttgtgtaaataagagaattatgttatgttttattgagagtcggtaaatcgttttgttagttttttttttttttttttttatatgtttattatagagggtatgtttaaagagtttttttttttattgtgattagttttttttttttttttgatttatttgtggaagtgattgtggagttatgagtattagagttttttttgaataatttaggttagttgagtttgttgttttagattagtagttatttaagatattggggattgaatagtttagatattttttgggaggaagtatagttatgggtttagtattgaaggaattataatttttatagttaagttttagggagtagtaattgggttggtttaggtggttgtaggatttttttgggtgatagtagtagatagttaggtttagagggaaaataggatggggtatttggtgtagagggagggtaaaggagagatgttatttgtgtatgagaaagaaagagggaagttttattaaggattttggagaattgtgtttagggagagtgaggagattttaatgtgttaagggatttagaaaaagaaatttattgtttaaatattagttttttttggggttttagttattagtgtgttttttattttttgttaaaggaaaaagtaggaaattttatgttgggtttatttttatagtttttattattagtataatgggcgaggtaagaagagataagaggtatttgttttgtttttagttatttgcgtgattttcgttgttagtgttgtttaaagattggtttgattttttgtttaatatttgttattttttagtttttaggtttacgtttggaatgtatattgaagttgaaattgaagtttaaattttttttttttagaggagattttatagaatggttttaaagtttagtattgaagtgtggaggttggtgttttattagtggtttaagtagttttatgttttagttaaggtgttaggttagagtttttgggatttagggttattaggtggttattacgtgaaagatattatatagtttgtgaattttttagacgataggatgtagtagtagtatttataggattgagcgtagttgttgtgaagttattttattaagcgtgtttggaggtaggatagttttgtatttaattttgtttttttatttttgttattttttttagtagttttaattatatagttatatttttttggagattggaaagattgttttagtaggagtgtttttgggaaagttttaaattaagtatttagaaatatttaggtaagtatatttaatgatgttgatggaaatagggtagtgatgattaatagaagtaaaagagagataggagaaagaaaatatgaagaattaaggaaggagaaattaaagaattatagagagttgaaa

SEQ ID NO: 45 - DNA, 5969 bp, Artificial Sequence
  Chemically treated genomic DNA (Homo sapiens)
ttaaggaggaaggatttataattgatttcgttgttttttattagtgttaaaatagattagtttagtgatgtttaagtggatacgatttagaagcgagacgtaaagaggttaaatacgggtaaatcgtacgtaaaattttgatattattgtaatacgttcgtggggtgggggtggtaagagtgttttagtatcgtagtttcggcgtagatcggaatttcgtagttattttggtggtttcgtggtgggaaagacgcgttttagcgaatcggtcgcgttattttcggagtacgttgggaattacggtaggttagggcgtaaagagagtagtcgggcggttttttggtgttatttgttggtttttcgtgtgtggtaagtattgtcgttttttcgttgattatttgttgggttattgtcgagaattacggttggggtgagaattgtggtttggcgttattttttagtgagggttattttggtgttcggaaagggcgttgggttattagtatattgttacgagtgggagtaggagttttgtagtcggatatcgtggattttgtttttgtttttttcgttttggttgtgtggttttttataggttatttaatttttttggggttaagttgttttatttgtgaagtggggattatagtatttatgttatgagagcgtttgaggagatgataggatgtatgagaaatgttttgttttttaaataaatgttggttttattattgttcgtttttttttgtttttttgttttttgatgttgtttttgtttgttttgtttttttgagataggattttattttgttgtttaagttggaatgtaatggtatgattatagtttattgtagttttgaatttttgggttagagcgattttttcgttttagtttttggagtagttgggattataggtatattttattttattttaaataatttttttattatttttagtagagatagggttttgttatgttgtttaggttggttttaagtttttgggtttaagtgatttttttatttgggttttttaaattgttgggattataggcgtgagttattacgatcggtttttaatttttatttattttgtttttttttaatggaacgaaagttttatgagattagaggttttgttttgatagattttaataaatgtataatattgtatgattattattataattaagatttaagatagtttcgtttttttataaaattgttttagttttttaattaatttcgtttattatttagtattagtaattattgatttgttttttttttttatagttttgttttttttagaattttatatatagggaattgtcgtggtttgaatatttgtttttttaaaattcgcgttgaaatttaatttttagtgtggtagtattgagaggtggggttttgaagaggcgattgggatatgagagttttgttataatgtttttataaatgaattaatagattaatgggtttaggggttaatgggttaatgggttatcgtgggagtgggattggtgtttttataaaaggaagaagagagatttgagttagtatattgaggtttttcgcgatgtgatgttttatacggttttaggatttaatagagtttttattagtaagagggtttttattagatgtagttttttaatttcggattttttagtttttatgagaaatgtttttgtgggattttttttatttaagtatattgtttttaagatttatttatgcgtttttttattttttcgtttttttttgtgagataaggtttggttttattgtttaagttggagtgtagttgtatgatttcggtttattgtaatttttattttttaggttttatttttattttagttttttaagtagttgggattataggtatgtattattatattcggttaatttttgtattttttgtagagatgggtttttgttatgttgtttaggttggtttttatagtttttagttggtgagttgaagaaattcgtttgttttggttttttaaagtgttggaattgtagttatgagtcgttgtgtttagtcgtatatgtatatttgtattatttatttgtttttttttattattggtatagaagggatgttttataggagtaggttttatatagggttgtttttttgattttaggttattatgagtaaaattattataaatatttatatataagttttgtgaatatagttttttattttttttgggtaaataatgtttaggtgtgggagtgttgggttatagtggttttaagggtaaatgatttttagttttgagttttttttttttagattttagttttttgttttaggtattgggatatattagtaataagaagtagtaagtttttttttttatttaggttatatttcggggatggagatagaaatatataaggaaagaataaataatatgttgtttttaaagaaattgtgtaaaaagaaaaaataaataagatgtttttgtatagtatagtagttatagagtaatgggttagaaagtggggtaggaggagaagttttttttagggaaagattttgagttgagatttgaggttttttaggtaaggggacggtgaatgtaagggtgtgtaggttatagggggataagttgggtgtgtttagtaattgtgttgggagttggatttagtagtgggggtttttattagagaggaggtagtattgagatttgggtaggaagttggggtttattttaagtttttttgaaaattaaagaagggttttaatttaaggattgtttttttttttttttttttttttttgtttgtagatagggttttgttttgttatttaggttggagtgtagtggtataattttagtttattgtaattttcgtttttcgggtttaagtgatttttttgttttagttttttgagtagttgggattgtaaatgtatgttattacgtttggttaatttttgtatttttagtagagacggggttttattatgtttgttaggttggtttcgaatttttgtgtttaagcgatacgtttttttttggttttttaaagtgttgggattataggcgtgagttatcgagttgggttaggttttaggtattgttatgatgtaaaaatttttttttagaaaagagaatattagttttttagttggttttttgtagttaggagatgtaagagtagtagttgaatttgaggtttgttttggagaaagaattaaaagtagatatggatggtttggatgtgagggagggaaagagaattttaagtgtattagtagtggtgggaggaggttcggtatagtggtgttatttggaagataaatcgttggtgtttaatttttatgattcgaaagttttttataagtttgatatattaggtaaaatgtttgattgtattaagttttagtttatcgttataaaataggttatgaaaattgcgtgagaaaatgtatataatagtttaataaataatattggttgggtgtggtggtttatgtttgtaattttagtattttgggaggttaaggtgggtagatcgtttgaggttaggagttcgagattagattggttaatatggtgagattttttatttttattaaaaaaatataaaatatatttgggtaaatatggtgaaattttatttttattaaaaatagaaaaattagttaggcgtggtggcgcgcgtttataattttagttgaggtacgagaatcgtttgaattcgggaggcggaggttgtagtgggttgagattatattattgtattttagtttgggcgatagagtaagattttgttttaaaaataaaatatatatataaaatataatagtatttgtttgtttgtttgtttttgagatgtttcggattatagtgcggggattatagacgtgagttattaagttcggataatattattatattgtttattgtatttttataatatttttaaggggtaggaatttttttttttagtttttttttttcgattttatcgagagatagggtttcgttttgtcgtttaggtttggagtgtattggcgcgattaaagtttattatagtttagattttttggttttaagcgattttttagtttgggttttttaaagcgttaggattataggcgtgggttatcgcgtttgattagttttttttttttgtagttgagttttaagagtttgtttaaagagtagaggtgggttgaaggtataaagcgaatgaaagaataggttttcgggtatcgttgtacgttttatttttttttaggggcgttgtattttagtttttttcgtatatgcgtattgggttttttatcgtttttcgtttttagtaaagtttttcgttcggagtatgcgcgggtcgtttggcgttaattgttgatcgttatagttatagttagggttagtttcgtcggttttcgggtggcgcgcgttcgttgtttttttagttttaggatgatcggttagaagacgttttattttttttttttttttagtttcgttaggaagcgatacgtttttagtttcgagtcggtcgtttaggggatcggcgtggttggggtgtttgaggaaagcggagatgcggcggtgaggcgcggtttgggtcggggttagggggtgaagggggaggaaggcggtgggtttcgtttgacggagggcgtgtaggatcgcgtttttgattcggtaaattcgggtttcgttttttaaatagtttttacgtgtttaaaatagtcgtcgttgttttttatgggtcgttatgttaaagggttagttaatgggaacgcgtttcggggtttatggcgttaattcgcgcgtcgtaggtttttttggttcggtgcgttgtttaattagaggggagagggggcgggatttagagggaggttttttgtcgcgaaaagattacgtggggacgcggtggggcgggtttggcgggggcggggtatttttgtgtagggtttttagttatcgcgacgtttttcgggaagttatagggcgttttttagttcgttttttcgttttagtttagaatttaatttttaattttcggatcgggtttagttttgggtttttattgttcgtttttgttgggatttgttttataaatgggcgttttttgttttgggtcgtgggggttgggtcggaagttgcggacgtttgggaaggggtcgttgtagtttttgagtcgtttttgcggggattatttgtaggttattttagttaagaaggtttcggttgggtaggaggagtttgggacgtcgtttttttcgtcgttgagtgtcgagtagttggatcggatttagaggaataaggtcgcggttttgtttagattcgcggttcgtaacgtgttcgtgggttttggagagagttggaagaagtattttagcggggagttcgggaaatcgtattttattaaggtaaatatggaaatgtattttttataagggtaaatgtggaggttgtcggtttttttgttttgttagtgtagtcggttaagtttatgttttcgtaggtttaggttgtattttttttaattttttttatttataaagggggtaaaagaaagttatgatgttttattttgtagttttatattggttaaagttgttaacgattcgcgagatgatattatggatttatttaagttatatagtttattgtttaggaaaggttggcgtagtaaaattattaattattttgaatgaaatttggtttgagttttaaaaagtcgagaggagtggtattgttaggatttagtttagagaaagaggtaaggaattgatttgattgaattatttaggtgggggggtaggtattgtttttgtttgttgttttttaaaagaatttggatataatatgataaagaattaatgatgttttaaataatttgtattagaagtttttttattgaatttttatggtttttaatgagaatttgattttaagtttagtttatttttaaattagt

SEQ ID NO: 46 - DNA, 5969 bp, Artificial Sequence
  Chemically treated genomic DNA (Homo sapiens)
gttgatttaaagataaattagatttaaaattagatttttattggaaattataagaatttaataagaaagtttttagtgtaagttatttggaatattattagttttttgttatgttatgtttaaatttttttaaaaaataataaataaaaatagtgtttgtttttttatttaagtggtttaattaggttaattttttgtttttttttttgggttgggttttgatagtgttatttttttcggttttttaaagtttaagttaggttttatttaggatggttggtgattttattacgttagttttttttggataatagattatgtgatttaaatgaatttatgatattatttcgcgggtcgttaataattttaattaatataaagttgtagagtgaaatattatggtttttttttattttttttgtgagtaaaggaggttgaagggggtataatttaagtttacggaaatatgaatttggtcggttatattaataagataaaagggtcggtagtttttatatttatttttatggaaggtgtatttttatatttattttgataaaatacggtttttcgaatttttcgttgaggtgttttttttagttttttttaaagtttacgggtacgttgcgggtcgcgagtttgagtagggtcgcggttttgtttttttggattcggtttaattgttcggtatttagcggcgaggagggcggcgttttaggttttttttgtttagtcggggtttttttggttgggatggtttgtaagtggttttcgtagaggcggtttaagagttgtagcggtttttttttaggcgttcgtagttttcggtttaatttttacggtttaaggtagaagacgtttatttgtggaataggttttagtaaaagcggatagtaagagtttagggttgggttcggttcgggaattgggaattaggttttaaattggagcggggagacgggttgggaggcgttttatggtttttcgaggagcgtcgcggtgattgggaattttgtatagaggtgtttcgttttcgttagattcgttttatcgcgtttttacgtggttttttcgcggtaaaaaatttttttttgggtttcgtttttttttttttttgattggatagcgtatcgagttaggagggtttgcggcgcgcggattggcgttatgggtttcgagacgcgtttttattggttggttttttagtatggcggtttatgggggatagcggcggttattttgaatacgtggaggttatttggaaagcggagttcgggtttatcgagttagaggcgcgattttgtacgtttttcgttaggcggggtttatcgtttttttttttttttattttttagtttcggtttaagtcgcgttttatcgtcgtattttcgttttttttaggtattttagttacgtcggttttttggacggtcggttcggggttgggggcgtgtcgttttttggcggggttgggggagaaaaaggagtagagcgttttttggtcgattattttggagttgaggaggtagcgaacgcgcgttattcgggaatcggcgaggttagttttggttgtggttgtggcggttagtaattggcgttaagcggttcgcgtatgtttcgagcggggggttttgttgggggcggggggcggtggaaggtttagtgcgtatgtgcgggaggggttggagtgtaacgtttttgggaggaggtggggcgtgtaacggtgttcgggggtttatttttttattcgttttgtgtttttagtttatttttgttttttggataggtttttaaggtttagttgtaagaagagaagattggttaggcgcggtggtttacgtttgtaattttagcgttttgggaggtttaggttggaggatcgtttgaggttagagggtttgagttgtagtgagttttgatcgcgttaatgtattttaggtttgggcgatagagcgagattttgtttttcggtggggtcggggggagggggttgggaagaaaagtttttgttttttaggggtgttgtgggagtgtaatgaataatataataatattgttcgggtttgatggtttacgtttgtaattttcgtattgtaattcgaggtattttaaaaataaataaataaataaatattattatattttgtgtgtgtattttgtttttgagatagagttttgttttgtcgtttaggttggaatgtagtggtgtgattttagtttattgtaattttcgtttttcggatttaagcgattttcgtgttttagttaggattataggcgcgcgttattacgtttggttaatttttttatttttagtagaaatggggttttattatgtttgtttaagtgtgttttgtatttttttagtagagatgggggattttattatgttggttagtttggtttcgaatttttgattttaggcgatttgtttattttggttttttaaagtgttgggattataggtatgagttattatatttagttaatattatttgttgaattgttatatatatttttttacgtaatttttatggtttattttatgacgataaattaaggtttagtgtagttaaatattttgtttaatgtattaggtttgtgggagattttcgggttatagaggttaaatattaacgatttgttttttaaatgatattattgtatcgaatttttttttattattattaatatatttaggatttttttttttttttttatatttaaattatttatatttgtttttggttttttttttaaagtaaattttaaatttaattgttgtttttgtattttttagttatagaagattagttgggaagttggtgtttttttttttagagagagatttttatattatgataatatttggggtttggtttagttcggtggtttacgtttgtaattttaatattttgggaggttaaggaggggcgtatcgtttgagtataggagttcgagattagtttggtaaatatggtgaaatttcgtttttattaaaaatataaaaattagttaggcgtggtggtatgtatttgtaattttagttatttaggaggttgaggtaggagaattatttgaattcgggaggcggaggttgtagtgagttgagattgtgttattgtattttagtttgggtgatagagtaagattttgtttataaataaaaaaaagaaaaagaaaaaaaagataatttttaggttaaaatttttttttggtttttaaaaaggtttagaataaattttagttttttatttaggttttagtgttgttttttttttgatggaagtttttattattgagtttagtttttagtataattgttggatatatttagtttgtttttttgtggtttgtatatttttgtatttatcgtttttttgtttggaaagttttaggttttagtttaggatttttttttgaaaaggatttttttttttgttttattttttagtttattgttttataattgttatattatataaaagtattttatttattttttttttttatataatttttttagagatagtatattatttattttttttttgtgtgtttttgtttttattttcgaaatgtaatttgagtgaagaaaggaatttgttgttttttgttgttggtgtgttttagtgtttaggataagaagttgaagtttaagggagagaggtttaaagttgaaaattatttgtttttagagttattatgatttagtatttttatatttaggtattatttatttaagggaaatgaaaaattatatttataaagtttgtatgtgaatgtttatagtgattttatttatagtaatttaaaattagagaaataattttatgtggggtttatttttgtggggtattttttttatattagtaataaaaaggaataaataagtaatataaatgtgtatatacgattgggtatagcggtttatgattgtaattttagtattttgggaggttaaggtaggcggatttttttagtttattagttgaagattatggagattagtttgggtaatatggtaaaaatttatttttataaaaaatataaaaattagtcgggtgtagtggtgtatgtttgtagttttagttatttgggaggttgaggtgggagtggagtttgggaagtggaggttgtagtgagtcgagattatgtaattgtattttagtttaggtagtagagttagattttgttttataaaaaaaagcggggaggtgggggggcgtataaatgaattttaaaagtaatatgtttaagtgaaagaagttttataaaggtattttttatagaggttgagaggttcgaggttgaggggttgtatttggtgaaaatttttttgttggtggggattttgttgagttttgaagtcgtgtagggtattatatcgcgaggggttttagtgtgttagtttaggtttttttttttttttttataaagatattagttttatttttacggtaatttattaatttattaatttttgagtttattaatttattaatttatttatgaggatattatgatagagtttttatgttttaatcgtttttttaaggttttattttttaatattgttatattgaggattaaattttaacgcggattttggaggaatagatatttaaattacggtaattttttgtatatgaaattttggaaaaggtaaaattatagggagagaagatagattagtggttgttgatgttgggtgatgggcgaagttgattaagaggttggagtagttttatggagggacggaattgttttagattttgattgtggtggtgattatataatattgtatatttgttgaaatttgttaaaataaagtttttgattttatggagttttcgttttattgaggggagatagagtaaataaaaattaggagtcggtcgtggtggtttacgtttgtaattttaataatttgggaggtttaggtgggaggattatttgagtttaggagtttgagattagtttgggtaatatagtaaggttttatttttattaaaaataataaaaaaattatttagggtggggtgggatgtgtttgtagttttagttattttagaggttgagacgggaggatcgttttaatttaggagtttaaggttgtagtgagttatgattatgttattgtattttagtttgggtaatagagtgagattttgttttaaaaaaataaaataaataagaataatattaaaaaataagaaaataaagaaaaacgagtaataatggaattaatatttatttagaggatagagtattttttatgtattttgttatttttttaggcgtttttatgatataggtgttgtagtttttattttatagatgaggtaatttaattttagagaggttaagtgatttgtgggaggttatatagttagggcggaggagatagaaatagaatttacgatattcgattgtagaatttttgtttttattcgtgataatatattggtggtttaacgtttttttcggatattaaagtaatttttattgagaagtgacgttaagttatagtttttattttagtcgtgattttcgatagtggtttaataggtgattaacgggaaagcggtagtgtttgttatatacgggaggttagtaggtggtattagagggtcgttcggttgttttttttgcgttttagtttgtcgtagtttttagcgtgtttcggaagtgacgcgatcgattcgttggggcgcgttttttttattacgaggttattagggtgattgcgggatttcgatttgcgtcggagttgcgatgttagagtatttttgttatttttattttacggacgtgttgtagtgatattagaattttgcgtgcggtttattcgtgtttaatttttttgcgtttcgtttttgaatcgtatttatttgagtattattagattgatttattttaatattggtggggggtagcgaggttagttatgggttttttttttttaa

SEQ ID NO: 47 - DNA, 11523 bp, Artificial Sequence
  Chemically treated genomic DNA (Homo sapiens)
attgtttaagacggaaagattttaagattgtgtgattttttttttttttttttttttttttttttttttataggtgtagaataattttttttttttttttcgtggttttttttttttttattttttttttttgttgtttgtaaagttgaatttggggttaggagttttaattgtaattttagattggaattttagatggtgcgtttaggattggaagtaatttttagtttattaattttatgggtttacgtatttgttttggttacggtttggtttttatttttattgtggtattaatgtagaataaattgagatatattttttatataattagttttagaatttaaaaagatttacggtataataatagaggtagtgtcgcggaatttttttattgaggattttcggggagttcggggattatttcgcggtggtattagaatagacgagtaattttagcggttttaggtattgcgaattgggggagagggggaaattttgtatcgtattcggtagtatttaacggtttcgggtttttagatagggttagcgaggagagttaggatagtaagtggggattggttaaaaaaaatcgatttaattttgaaatgattagaagaagttgggagtagttattataaagttttttttttgtttttttttttttttaattgaaggaatgacgttgaaatttttatcgttagcgcggggttgggaattattttaaatatttgttttgtagtttcgagtgggtagatttcgaagagttggagtcggcggggaggggaggaatagttgttgggttgttttgcgcgtggggttcggggcgcgggtttcggggagaggcgttagtcgaaagtttgtttttttttcgcgataggtagtagcgaggtcgagttattttttattacggtttgcgggtttcgcgcgtagtgtggttgttttcgtttttgatcgatcgtagcgttttggggtgtttatttagttgttcgcggtcgttgggtgattttcggagggcggtttaggcgtgcgtattggtttttggggttgcggttgtagtagtttagtttcgcgttttgttagatgtagtggatagcgtcggggtgaaagtaagggttgagaaatttttattgttttgtttttatttagtttcgatttttttatattgtaataattatgtattttcgaggtcgggatgtttgcgttttgttagtgtattaacgttatatggttttttaggggttgttttcgtttttgtattttattagttttgaagaggtagaggggtggtgggtaaaatttttaattggacgttgagagattcgggttttagttcggcgttgttattaatttgttttttgtttttaaatagtagtagtaataaaaattgtaaagttgattgagttaaaggtttatattgtttttttatttaatttttagaataattttatgaggtgggcgttagtattttattatttcgtttgattagtaaggaaattgaggtttagagagattgcggaattcgtttagggttatatagttgttggttatttggtagagttgaggttttattttggggttattaattttttgttttttatcgttgcgttttatagattgtttttttttcggttgtttgggttttagtttttttttttgtaaaacgagaagtttaatttgtagttttttttgttaatcggtggtttagattaggaatttttgttatagatttcggcgttgataggggtaagaaggtgggtgaaagaagggggcgtttagttttttatagtttgtttttttttgggatttcgcgaagggcgggtttcgcgagttaaaggaggtataggagagcgtttatcgttcgcggcgggtgaaggtgttatttgttttcgtgttaggttgtgagttttggtgtttagtttagggcgttaaggttagtgtagttggtatgttttttttggaaaattttaggtttttcgtagagaacgttatttataataaagaagaggatagagaggtatggagcgttttgcgattgtaggagtacgttagttttttagcgttggtttagtgtcgtttgggttttcgggtatgtggattcgttggggtcgtacggagattttttgtcgggtttttggggtttttcgattgcggttttttagtttagtattttttttttggtttcgtaggttgtagggaattttttttatttttttagtcggagaagtttaagtcgggcgagggggtatttcggggttcgtatcggtgtttttttttttttcgtttttataaggattttgagaaaataaatggtagaggagagaggagttttatatttgtttggtttttttttttttttatttatttttatattttttatttcggggtaaaaatttatttttgaaaaatgttggtagagatttacgtgtttttgttttatttgggttttataaatataacgatttatatttaagttagtttttttttagataatttttttttttttcgttaaaagtgttaaggatggtaaaagaagaaataattttaattttttcgtttggaaatgaaagttttcggttttttataaagggtttttcgttttttatagttgagttttagttaagaaaaacgatttttaagtagaaataataggcggggagaaggaagggagatatagggatttggggggtttttagggtaattggtagtgaattttgtttcgagagttttttttttatttaaaaaattaaacgcgcgagtttcgcgaaaggtttagggatagatcgtgtgggagaggattgagtagagagcgtgggggtagtgttttgtagaatttttttttttttaataataattttaaaagtttttgagtggagacgacgtaaagttaagtagtaaaggtggtttgggaggtaagcggagggtttaagtgtcgtatttttatttttagggttttttgcgtttacgggatgcgtatttttaagaagtgcgtttttcgagtaagttttgggttcgtatatatttcgggttcgtagttagaatttaatggcgataacgtttatgtaatgtaagttaaaaattaaagcgtaaaaaattattatgttatttattgaaacgttattttttgttaaattgtaattattttgttttatataagtttggttggaaagtttgtagttttagttcgggttagttaggtataggaggtcggattgtaatcggttgtttttttttcgtcgcgtttggtcgttttacgttgcgtcgtcgttgttgttttttggcgtttttgggattttatacgtatttttgaaatacgtttcgtttcggttttcggtttttttttttgtttaggggttgttttttaatagatattgatttttttagaagatttaaaaattaaattaaaatattttttattcgttttaaatatttgttttggggcgcgggggttgttaaatagagattagacgaagggagttagatttagcgaagtttttcgagtttttaaagattcgaatattaattcgcgttcgtgggtcgatggaggttttttttattttattttttggtttttttaattggttttcgttttttggttaattattgagtaattagaatggtattttcgattagggttataggtagtgttcggcggagtggttttaggagttattcgttttttgtcgggtttcgtatttaaatttttttttttattttttttttttaaattgggcgttaggatgtttcggtcggaatatacgtaggttttgggcgtttgtttaagggttttttttttttttaaattagtcgttgttttttcggtttaatcgtagaagaattagatattttttattggaaagggaaattaagtgttgttgattttaattttaggtaggcggtaatcgtttttcgtttggcgtaaattttattaagtaaataattattagtcgatcgaaatacgttcggtttataattggtgtaattttcggttatttaattgagggacgttcgtttttagtttcgatttttggaatttataaagggttatttttttttttagtgattttaagattatggttatttttttattcgatagttttagaagtaagagttagatttaagggtgtaaagtaagggtatacgtttttttgaagtttgattgagttttttttgcgtttttttgaagttttcgtttttttggagtttatttgtttttttttttaaattatttttttagattaataattttatttttatttttatcgtattcgattttgttcggatttattgtttatttgaacggattttttagtgagacgaggtttttatattggcgaaggttaagaaggggaggtggggggagggttgtgttatatcggttagttgagagcgcgtgttgggttgaagaggagggtgttttcgagagggacgttttttcggattcgtttttattttagttgcgagggcgtttttaaggagtagcgcgcgttgtttggtcgggtttgggttgttgagtgaatggagcggtcgagttttttggttttttttttttttcgcgtcgtcggttttttttatttgagttttgggaagttgagggtagttaggtagttggggtaaggagtttaaggtagcgtttatattcgggggtttttcgtaattcgatcgtttgttcgtttttttatttttcgtttttttttttatttatttatttatttatttatttatttagagtcgggacggtagtttaggcgttcgggtttcgtcgttttttcgtcgcgattttggatttttttttgttgtaggattcggtttttacgtgtgtttcggagtcggcgttttagtatacgtttcgtttcgggtttgggtgtttatagtagttagagtagtagggagttcgggattcgggcggtatttgggttaagttaggcgtcgtcgaggttagcgttgaacgtttttagggtcggaggagtcgcggggcgttcgggtttgagtcgtagtaaatgggtttcgacgtgcgggatttgaacgcgttgttgttcgtcgttttttttttgggtggcggcggcggttgtgttttgtttgtgagcggcgcggcgtagtgggcgtcggtgttggattttgcgttttcgggcgtttcggtttacgggtcgttgggcggtttcgcgtcgttatcggtttcgtcgttattttcgtcgtcgtcgttttatttttttattaaataggagtcgagttggggcggcgcggagtcgtacgaggagtagtgtttgagcgtttttattgtttattttttcggttagtttattggtatagtcggagtttgtcgttacgggtttttcggttttttttcgtttagttaggcgttattcggttaggttaggatgttttttaacgcgttttatttgtttagttgtttcgagagttagttcgttattcgtaattagggtaagtaggtcggggagcgttttttacgcgcggggtagtggcgttagggatttttcgttttaggatattttttttttttattttttttgatcgtagtttttatttagttgttttttaagggtcgtgaggatagcggaagcggcggttggggaggaggtcggagagtgggagtgtacgtaggtattggttttcgatattttttaaagttaggtagagttaggagtttgattgttcgtaagagtcgggagggcgtttggggttttttagagttcgagagatttcgggattgttagtttttacgggagtggaattaggagatcggcgtagtgtttggttttgttttggggagagttttgttaattaaggaaacgttaaattgttattaagcgtagcgttttttagacgtttggattttggattcggagtgggattagcgcgggggtgagcgtttgtgttgtgttgttttcgtagcgttaaaatgtttaggagtatttttagtttttataatacggtgttggtatatatttaggtgtatattaagtatcgtagagaattagaatgagtatatgtatttttagtaattaaatggttttttggaatagcgtcgtgttcgtggatagttttcgcgtatggtaatatagaagtggatttttattgggtttcgtttaggcggcggttacgtaggttttggggatggaagagaatttgatttattcgagtttaagttatgcgggattaggttttatcgtaggtagtggaaggaggtacgagttttggttttttttttagcgtatttggggcgtttttttattttgtaaacgcggggtttagttgggatagtatttttttaagatttggggttagaataaggatagggttattcgttgtgtttagttaggatataaggagggaattcggtatacgataagtattaggttggttttttatttcgcgtcgatgttcgtttatttttttttcgtttgggcggcgcggattcgaatttgcggagtttttgtagtttgttttttttatttatttttagtggatttttacgttattgagaatttaagttagttcggtttgattcggtaatttagtaaacgttttattaatataatggcggatgttttttttggagtaaaattattcgagggtttagggatcgggatgtttttggaatgcgtgggaagtagagtgtattttttgtaggaggtattttcgtttaaggttcgggagaagggttttgtttttgttgttcgtttttattcgcgttttttaaacgcgcgtttttaggtcgtttttattttagtttaattaggagtattcggttttcgcgaagttttggagaaatcgaaatcgttttttttttcgggagaatttgggattattgttttgtggaggaatcgtaagtagatttaagggttgtttttattttatgtttttagttagtgaaattagtgttttgtatttaaggggcgttgggataatttattggtcgttgaggtttgtgttttttgattagatcgcgttatttttgtttagtaggttggtgttatttttggggagtttttaggttttagtgttttcgtttataagaggatagttgagatgggtaatttggagattgggttcggtttgaagttatattttatagatgtagaagcgttatttattatttttttggggttttaaatatggaattcggtaatttatttaaatatttgtgattgagaaataatgaattcgagagtattgtttgtatgtgtgttatttggaggcggttgagaaattatcgaatttatgtttttggggtataaaatattattacgttattatttttttagtatttttaggggatttttgaaatttgggttttgtcgtttcgtttgggttttttgtttagttttttttagggtaggtttggtgtttgggattttattatatgtcgtggggggtgggattgtgggttttgtagttagtaggtattatatttttggaaaatatttggatttttttgtaatatataggcgtggttgttatggagaaaaagttaaaaggggattaggattagtaggtgaatgtattttttttttttattttggagaaaaagtttaatggagagagggttttagatttaagttatatagtttggaagtattatttttaggtttaagttttgttttgtagtgaaaatagatgggtttattttatttagtttttgaggtttattgggtagtttggatgtgagaagcgtttcggttgttattttggagtgggtaagggtggttttcgagattttgggtttattttttggatttttagggtttttgttgtttttttaggaatgtagggtttggtttaagatttgggttgtgagaggtaagggtattaatttttaaaaatgtggaaatggttattagagcgttaaggttaaattttaggggagaggaattaaggtcgtttttggatttttagggtagtttagttatggtgtataggtaggggtaattgttggtatttatttataatcgtttaaaattttataagtatgtttatattttaaatttttaaatattatattttgtattttaattttgtaaatattaatttagtaaatattaatcgtttatttggttaggtattgggttttgaatattaattaagataatggtttcgagaatttttgtaagaagtttattagttaattttggagaggttttttgttttggatgaggaaatttaggttttatgagattaggtggtagaggtgggatttgaatttagattatgttagggtgtttttattttttttttagggattttggttttatcgttgagatggattttttttggtttgcgggaggggtattaaatttttagtttatgtgtgggggttgacgggtttgtgagggtagatgtggggtgaggatttgagtagttttagattagatgtaaggtttaaggaggaggggaaaaaagtttgtttgggtcggacgcggtggttcgaggcggttggattatttgaggttaggagtttgagattagtttggttaatacggtgaaattttgtttttattgaaaatataaaaaaaaaaattggtcgggtttggtgacgggcgtttataattttagttattcgggaggttgaggtataagaatcgtttgaattcgggaggttgaggttgaagtgagttgagatcgcgttattgtattgtagtttgggcgatagagcgaaatttcgtttcggaaaaaaaaaaaaaaaaaagaggttgtttgttagtttattgatttcgtagtttcgtaggttcgtagaattttaaggtatgattaggtttgggattattaggttattttagggttaggtgcggaggtttgcgacgttcgagggttaaaggttttttttttcggttatataggagagggtattttgttgggggataggttttttttaattatagtgtagttgtagttatcgtttttagttttttgagtatttttttggttgagtttgttgtttattttattttttagtttttacggttcggttaggttaggcggttttcggtttttttgtagtcgtcggcgggggaggagggtatagagcgcgtttcgttttttagcgtacggttaaggttgcgtttttttttcgggtcgggattaatcgtgggaaaggcgttattttggttattcgattttttttttttaaggtttgtataaggagtttttgaatacgttgttttttttagtcggtagttttattttttttggtttttgttttcgtatttttcgcgttaggttaagcgttgggtttagggatagcgcgttttaattaaattcgtgttcgataagtttttaattaaaagagattttttttcgtttcgtaggcgtttttattattgtttttttcggggggatttgaaggagagggtttgaggtcggtttttgttcgtcgaggtttgcgtgttcggtttgggaggaggtttaggagggttcgcgggttacgggtatttttgggttcgagttttggggtgcggacggacgtttcgagagtgggtgtcgcgattcgggatttacggttttcgtcgggtacggatagttgcggagtagggttttgaggattgtgtagtgttttgggtttttgtttatttttgggtttaggaatggagaagggttcgtttagagaaaattttttcgtagtttttatttcgtttttttttttttttttttttttttttttttttttttttttttttttttttttttttttgtgtttgtttttttttttttttttttttttttagtgtttttttagaaattcggtttttatttcgggtaatagtgggtgttttgagttaaatttcgtttgtaagtttatttataggttttaaagaaggttaggttttaggttttaaaaggaagtttgtggaagtttaaacgtgttcgtttatgtaggagagttaacggggtcgggggttatttttgtttatttagtaggagagaaatggaggttttcgaggttatatgataaaagttagtggttttttaaatttttagtgtgtggtgttgagtagtgtgtgagatttaagtttggatttgtattattcgggagttaggatttgtttttttttttttttttttgtattttgttatattattttttaggtttatgtttttgttgttttagagaagttttttttttttttttttttttttttttttttttgggcggggggtggtggtgtgtgtgtatgagcgttcgtgtgtgtttcgaaaatggaggtaacgatgttttgggttttgtttatcggttgagttttgtttaagtttttggaggtattttggttaaatagtgtaagagtgggagaatgggtgttgtttgatttaatttatttttgagaattttgtgaagtttggagatttagggtagttttgggttaggaggatttgaggttgttggggtggttttgttaggattttataggagtagttttttttagttattgtgtttggattttaggttatagatttcggaatttgtagaggaatgagattttatttttgggtttcggggttaatgacgtatttttagtcgaaggatttttttttttagaggtagtaatagttttttagaagtttgtggggtataagtttaaagtaatttaataataaaaattataaaagattatgttttttaattgaggttttacgtttttttttttattttgggggggggggggaatgttaggatttttttagggggaaattgaggtaaaggatcgaagtattattatggagggaaagggagatatagtgttaggtatattttaaaggaaattggttgtttagtttggggagtgaggaagttggtttttatagtagtggttagggtcggatttttgggcgtaaggtgggttttataggggggaggaggaggagagcgtagggtcgttatttgaaggtttaattggaaggggtttttgtttttttttttattagtttttttttgggtgttatggtgttaggtcgggtagttttagatagataatattattcggtaattattttttttatttttaagattaggttatttaattggtttcgagtaattaatgaaagttggtgcgcgggtttttgatttatagttcggagttaacgcggggttagtttagtagatttatttcgtttgttcgcgttgtttttgcggaagagttgtagtttatttttggggggtgaataattttttttgtcgattaggtaacgagttttatatttaatttgttaggggttcgttgtagaagcggtagagatcgtagaagattgcggtataaataaattgggaaaaagcgaggtgggggttttagttagaaaaggatggagaagtttgttttaaggttatatttagggatttgggtcgtttttttgtcgaaagttttggaggtttgtggggttggattttttttcgttgggggttcgaatgcggggtttagcgtatatttttttcgttcgtggttggtttagatttattgtttcgttttgcgagagtatcgttgatattgtgttttttttcgtcgttttcgtagg

SEQ ID NO: 48 - DNA, 11523 bp, Artificial Sequence
  Chemically treated genomic DNA (Homo sapiens)
tttgcgggagcggcggagagaagtatagtgttagcggtgttttcgtaagacggggtagtgggtttgaattagttacgggcggggggggtgtgcgttgaatttcgtattcggatttttagcggaggagaatttagttttataagtttttaggattttcggtaggaagacggtttaagtttttggatgtgattttgggataggtttttttatttttttttgattaaaatttttatttcgtttttttttaatttatttatgtcgtagttttttacggtttttgtcgtttttgtagcgaatttttggtaaattaagtataaaattcgttgtttgatcgatagagaaggttgtttattttttaaaaataaattgtagttttttcgtaggagtagcgcgggtaagcgaaatgaatttgttgggttaatttcgcgttgatttcgagttgtaaattaggggttcgcgtattaatttttattaattattcggagttagttaaatggtttggttttaaaaatgggaagagtaattatcgagtaatgttatttgtttggggttattcgatttgatattatgatatttaagggaaagttggtgagggggaaaataagggttttttttagttgggtttttagatggcgattttgcgttttttttttttttttttttatgggatttattttgcgtttaggggttcgattttgattattgttgtaggagttaatttttttattttttaggttggataattaattttttttagagtgtgtttgatattgtatttttttttttttttatggtagtgtttcggttttttgttttagtttttttttagggaaattttagtatttttttttttttttaaagtgagaaaaagagcgtggagttttagttggaaaatatagttttttataatttttgttattaaattgttttaaatttatattttataagtttttggaaagttgttgttgtttttggggaaaaggatttttcggttaaagatacgttattggtttcggaatttaaggatggggttttatttttttataagtttcggagtttgtggtttgaagtttagatataatggttaaggagagttgtttttatgggattttggtagggttattttagtagttttagatttttttggtttaggattgttttgggtttttaaattttataaaatttttaggagtaaattgggttaaatagtatttatttttttatttttgtattatttgattaaagtgtttttaaagatttaagtaggatttagtcgatgagtaggatttagggtatcgttatttttattttcgaaatatatacggacgtttatgtatatatattattatttttcgtttagaaaaaaaaaaaaagaaaaagaaaaaaaaaaagtttttttggggtaatagaggtatgagtttggagggtggtgtggtagagtgtaagggagggaaggagggggtaaattttaattttcggatagtataggtttaggtttaagttttatatattgtttagtattatatattggggatttgagaagttattagtttttattatatgatttcgagggtttttattttttttttgttaagtgggtaaagataattttcggtttcgttagtttttttgtatgggcgagtacgtttgggtttttatagatttttttttgaaatttgaggtttggttttttttgaggtttatagatgagtttataaacgaaatttggtttagggtatttattattgttcggagtgaaggtcgaatttttgaaaggatattaaaaagagagagagagaaagagagatagatatagagagagagagagagagggagggagagagagagagagagagagagagagagagagagacgaaatagaagttacgaagaagttttttttagacgaatttttttttatttttgagtttaggagtaggtagggatttagggtattgtataatttttagagttttgtttcgtaattgttcgtgttcggcgagggtcgtgggtttcgagtcgcggtatttattttcgagacgttcgttcgtattttagaattcgggtttaaggatgttcgtggttcgcgagtttttttaggtttttttttagatcggatacgtagatttcggcgggtaaagatcggttttaaatttttttttttaggttttttcgggaggggtagtggtgaaagcgtttgcggagcggagggaggttttttttaattagaagtttatcggatacgggtttgattagagcgcgttgtttttgggtttagcgtttggtttggcgcggagagtgcgggggtaggggttaggggaggtaaagttgtcggttggaaggagtagcgtgtttaaaggttttttgtataggttttggagggagagaatcgagtggttaaggtagcgttttttttacggttagtttcggttcgggaggggagcgtaattttgatcgtgcgttaagaggcgagacgcgttttgtgtttttttttttcgtcggcggttgtagagaagtcgggaatcgtttggtttggtcgggtcgtgagagttgaggggtgaaatggatagtaggtttagttaggaaggtgtttagaaggttgaaaacgatgattgtagttgtattgtgattggggaaaatttgttttttaataaaatatttttttttgtgtgatcggaagagggagtttttggttttcgggcgtcgtaggttttcgtatttgattttagggtggtttgatgattttaggtttaattatgttttagggttttgcgagtttgcggggttgcgggattagtggattagtaggtaatttttttttttttttttttttttcgagacggagtttcgttttgtcgtttaggttgtagtgtagtggcgcgattttagtttattttaattttagtttttcgggtttaaacgatttttgtgttttagtttttcgagtagttgggattataggcgttcgttattaagttcggttaatttttttttttgtatttttagtagagatagggttttatcgtgttggttaggttggttttaaatttttgattttaggtgatttaatcgtttcgagttatcgcgttcggtttaagtaagtttttttttttttttttttaagttttgtatttagtttggggttatttaagtttttattttatatttgtttttataaattcgttaatttttatatatggattaagagtttggtgtttttttcgtaggttagaagaaatttattttaacggtggggttaagatttttggaaaaggagtagaaatattttagtatggtttgggtttaaattttatttttgttatttaattttatagaatttggatttttttatttaaaataaggggtttttttaggattagttggtgagttttttgtaaaggttttcgaggttattgttttaattaatatttagaatttagtgtttgattaagtaggcgattgatgtttgttaaattaatgtttataagattaggatgtaagatataatatttaagaatttaaaatatgaatatgtttgtgaagttttgggcggttgtgagtgggtattaataattgtttttgtttgtgtattatggttagattgttttagggatttagagacggttttgattttttttttttggggtttggttttggcgttttgatggttatttttatatttttgagagttgatgtttttgttttttatagtttaagttttgggttaggttttgtatttttggggaagtagtaggaattttggaaatttaaagaataaatttagaatttcgagggttatttttgtttattttaggatagtagtcggagcgttttttatatttaagttgtttaatgagttttaagggttgggtaagatggatttatttgtttttattgtaagataaaatttaaatttggagatggtgtttttaggttatatgatttgaatttagggttttttttttattgggttttttttttagggtggagaagaaggatatatttatttattagttttggtttttttttaattttttttttatggtagttacgtttgtatattatagaagaatttagatattttttagaagtgtaatgtttgttggttgtaaaatttatagttttattttttacgatatgtgataagattttaggtattagatttgttttgaaaagggttggataagggatttaaacgaagcgatagaatttaggttttaaaaattttttagaagtattaaaaagataatggcgtagtagtattttgtgttttaggggtatggattcgatggttttttaatcgtttttaaatagtatatatgtagatagtgttttcggatttattgttttttagttatagatgtttagatgggttgtcgagttttatatttaaagttttaagagggtggtgggtagcgtttttgtatttatggagtataattttaagtcggatttaatttttaggttgtttattttagttgtttttttatagacggggatattgagatttagaaattttttaaaagtaatattagtttgttaaataaaggtggcgcgatttgattaaagaatataagttttagcgattagtaagttgttttaacgttttttgagtataaaatattaattttattaattaaaagtatagagtggaggtaatttttgggtttgtttgcggtttttttataggatagtgattttagattttttcgaagaaaagggcggtttcgatttttttaaggtttcgcgggggtcgggtgtttttggttaggttaaggtaggagcggtttgaagacgcgcgtttagaaggcgcgggtgaaggcgggtaataagggtagagtttttttttcgagttttgggcgaaggtattttttgtaaaagatatattttgttttttacgtattttaaaaatatttcggtttttaggttttcgagtaattttgttttaggaaaagtattcgttattgtattagtaaagcgtttattaaattatcgaattaaatcgaattggtttaggtttttaatagcgtggaaatttattgaaaataaatgaagagggtaaattataggggtttcgtaggttcgggttcgcgtcgtttaggcgaaagagaggtgggcgggtatcggcgcgggatgagaaattaatttgatatttatcgtgtgtcgagttttttttttgtattttgattaagtatagcgaataattttgtttttgttttaattttaggttttgaagaaatattgttttagttgagtttcgcgtttataagatgaagaggcgttttagatgcgttgaaagaaaggttaaagttcgtgtttttttttattgtttgcggtagaatttggtttcgtatagtttggattcggataagttaagtttttttttatttttagaatttgcgtggtcgtcgtttgagcgaagtttagtgaagatttatttttgtattattatacgcgggagttatttacggatacgacgttgttttagaaagttatttagttattggaggtgtatgtgtttattttagttttttacgatatttaatgtgtatttaagtgtgtgttaatatcgtattataagggttggaggtgtttttggatattttagcgttgcggaggtagtatagtataggcgtttattttcgcgttggttttatttcgaatttagagtttagacgtttgaaaagcgttacgtttggtgataatttggcgtttttttaattaataaaattttttttaaggtagagttagatattgcgtcggttttttggttttattttcgtggggattagtagtttcggaatttttcggattttaaggggttttagacgttttttcggtttttgcgaatagttaggtttttagttttgtttggttttggaggatgtcgggggttagtgtttgcgtgtatttttatttttcggttttttttttagtcgtcgttttcgttatttttacggtttttgggaagtagttgggtaagagttgcggttaaaaggggtaggagaggggggtgttttagagcggagagtttttggcgttattgtttcgcgcgtagggggcgtttttcggtttatttattttgattgcgaatagcgggttggttttcgaggtagttgggtaggtagggcgcgttaggaaatattttggtttggtcggatgacgtttggttgggcggaggaggatcgaagggttcgtagcgataggtttcggttgtgttagtgaattggtcggaaaagtggatagtgaaggcgtttaggtattgtttttcgtgcggtttcgcgtcgttttagttcggtttttgtttgatgaaggagtgaggcggcggcggcgggggtggcggcggagtcggtggcggcgcggggtcgtttaacgattcgtaagtcgaagcgttcgggggcgtaaagtttagtatcggcgtttattgcgtcgcgtcgtttataggtagggtatagtcgtcgtcgttatttagggaggggacggcgggtagtagcgcgtttaggtttcgtacgtcggagtttatttgttgcggtttagattcggacgtttcgcggttttttcggttttggagacgtttagcgttggtttcggcggcgtttaatttggtttagatgtcgttcgggtttcggattttttgttgttttggttgttgtaggtatttaggttcggagcggagcgtgtgttgagacgtcggtttcgggatatacgtggaagtcgggttttgtagtaagaggaagtttaggatcgcggcgaggagacggcggggttcgggcgtttgggttgtcgtttcggttttgggtgggtgggtgggtgaatgagtaggtgggagggagggcgggaagtgggggagcggataggcggtcgggttgcggagagttttcgggtgtgggcgttgttttgaattttttattttagttgtttggttgtttttagttttttaaagtttaaataagaggggtcggcggcgcggggaagaggaggagttaggaggttcggtcgttttatttatttagtagtttaagttcggttaggtagcgcgcgttgttttttgggggcgttttcgtagttggggtgagggcgggttcgagggagcgtttttttcggagatatttttttttttaatttaatacgcgtttttagttggtcggtgtggtataattttttttttattttttttttttggttttcgttagtgtgggagtttcgttttattggagagttcgtttaggtaagtagtgagttcgggtagggtcgaatgcggtgggagtagagatggggttgttaatttaaaagagtggtttggagggaggggtaggtaggttttaagagggcgggaattttaggaaagcgtagaaagaatttagttaagttttaaagaagcgtatatttttgttttgtatttttgagtttggtttttgtttttagaattgtcgggtaggggagtggttatgattttggggttattggggaaagaggtggttttttgtgggttttagaggtcgggattgaaagcgaacgttttttagttgggtggtcgggagttgtattagttataagtcgggcgtatttcgatcggttagtagttgtttatttggtgaggtttgcgttaggcggaaggcggttgtcgtttatttaaaattggagttagtagtatttagtttttttttttagtgaggaatatttaatttttttacggttaagtcgggaaaatagcggttagtttaggagggaagaaaatttttgggtaaacgtttaaagtttgcgtatatttcggtcggagtattttggcgtttagtttggggaggaggggtgaaggggagggtttggatacgaagttcggtagggagcgggtaatttttggagttatttcgtcgagtattgtttgtggttttggtcgaggatattattttggttgtttagtgattgattaggaggcggaagttagttaaggggattaaggagtggagtagggagaatttttatcggtttacgggcgcgagttagtgttcgaatttttgggagttcgaagagtttcgttaaatttgatttttttcgtttagtttttgtttggtagttttcgcgttttagagtaggtgtttggggcgggtagggggtgttttggtttggtttttggattttttaaaggagttagtatttattgggaaataatttttaggtaaggagaagaatcgggggtcggagcggagcgtgttttagaggtgcgtataaaattttaggggcgttaggaggtagtagcgacggcgtagcgtgggacggttaggcgcgacgggagggaagtaatcggttgtagttcggttttttgtatttggttggttcgggttggggttgtaagttttttagttaaatttatgtgaagtaaagtagttgtagtttgataaagaatggcgttttaataaatgatatagtaattttttacgttttggtttttagtttgtattgtataaacgttgtcgttattaaattttggttgcggattcgaagtgtgtgcgggtttaggatttattcgaagggcgtattttttgggaatgcgtatttcgtaggcgtaggagattttgagggtaaagatgcggtatttgagtttttcgtttgttttttaggttatttttgttgtttgattttgcgtcgtttttatttagaagtttttaaaattattattaagaaaagaaagattttataagatattgtttttacgttttttgtttagtttttttttatacgatttatttttaaatttttcgcggggttcgcgcgtttggttttttgagtggagaaaggattttcgagataaaatttattgttagttgttttaagaattttttagatttttgtatttttttttttttttttcgtttattatttttatttggaagtcgttttttttaattaggatttaattgtgaggggcgaggagttttttatgaaaagtcggggatttttatttttaaacgaaaagattgagattgtttttttttttattatttttggtatttttagcggggggagaggaggttatttgaagggaggttggtttgaatgtgagtcgttgtgtttgtgaaatttaggtaaggtaaagatacgtaaatttttgttaatattttttaaaaataagtttttgtttcggggtgagggatgtaggggtggataggaggaaaggagagttaagtaaatgtagaattttttttttttttgttatttatttttttagaatttttgtgggggcggggaggggaagagtatcggtgcgaatttcggggtgttttttcgttcgatttggattttttcgattaaagaggtgggaggagttttttgtagtttgcggggttaagaagaaagtgttaagttgaggagtcgtagtcggaggattttagggattcgataggaagttttcgtacgattttaacggatttatatgttcggaagtttaggcgatattaagttagcgttggggaattgacgtatttttgtagtcgtagggcgttttatgtttttttgtttttttttttgttgtgggtaacgttttttgcgggagatttgaggttttttaagggggatatgttagttatattggttttggcgttttgagttaagtattaggatttatagtttagtacgaaggtaggtagtatttttattcgtcgcggacgataggcgtttttttgtattttttttagttcgcgaggttcgtttttcgcgaggttttagagaaaagtaggttgtggaaaattgggcgttttttttttttatttatttttttatttttgttagcgtcgagatttgtagtagaggtttttggtttgaattatcgattggtaaagaaagttgtagattaaatttttcgttttatagagaaggaaattgaggtttagatagtcgaaggagaggtagtttatggagcgtagcggtaaagagtaaggggttggtggttttagaatggaattttagttttgttaggtaattaatagttgtgtgattttagacgagtttcgtagtttttttgagttttagtttttttattggttaaacgggataatgggatattagcgtttattttatagagttgttttgaggattagataggagagtagtgtgggtttttgatttaattaattttatagtttttgttattattattgtttaaggataggaaataagttagtggtaacgtcgagttgaaattcgggttttttaacgtttagttggaggttttatttattatttttttatttttttagagttaatgggatgtagaggcgaggatagtttttggaaaattatgtggcgttgatatattggtaaagcgtaggtatttcggtttcgaaggtgtataattattgtaatatgaaaaaatcgaggttgggtaggagtagggtagtgaggattttttaatttttatttttatttcggcgttgtttattgtatttgatagagcgcggagttgggttgttatagtcgtaattttagggattagtgcgtacgtttgggtcgtttttcgggagttatttagcggtcgcggataattgaataaatattttaaagcgttgcggtcggttaagggcggggatagttatattgcgcgcggggttcgtaggtcgtaataaagagtggttcgatttcgttgttgtttgtcgcgggagaggaataagttttcgattagcgttttttttcggggttcgcgtttcgagttttacgcgtaagatagtttaatagttgtttttttttttttcgtcgattttaatttttcggaatttgtttattcggggttgtagggtaagtgtttaggatggtttttagtttcgcgttggcggtgaaaattttaacgttatttttttaattaaaaaaaggggggggtaagggaggggttttgtgataattatttttagttttttttgattattttaaaattaagtcgattttttttaattagtttttatttattgttttaatttttttcgttgattttatttgggagttcggaatcgttaggtattgtcgaatgcggtgtaaaattttttttttttttttagttcgtagtgtttggagtcgttggggttattcgtttgttttgatgttatcgcgagatggttttcgagtttttcgagagtttttagtgaaaggatttcgcggtattgtttttattattatatcgtaaatttttttaaattttggaattaattatatagaggatatgttttaatttgttttgtattaatgttatagtggggatggaggttaggtcgtggttagagtagatacgtaggtttatgaaattgatgaattgagagttgtttttagttttgagcgtattatttggaattttagtttgaggttataattagaatttttgattttagatttaattttgtaaataataggggaaaaaaatggggaaaagaaaaattacgagagagggaaaaaaaattattttgtatttgtaaaaaaaaaaaaaaaaaaaaaaaaaaaaaaaaagttatataattttaaaattttttcgttttagataat

SEQ ID NO: 49 - DNA, 6050 bp, Artificial Sequence
  Chemically treated genomic DNA (Homo sapiens)
tatttttttttgttaaaaagttaagagttgtttagaaggaaaaaatagttttttttaaagaggttaaatttttagtattaattagttgtagtagtggtatgtgtgtgtgtgtggggggggggtggtatggtaattttgtgtttttagtgttttaaataggggtaatttttttgtttacggtttgagttatcgaatgagtaatttcgattttttaagattttttattgggtttacgtgtgtgtgagttttataggaattgtggaatgttttttttttttgttgggtttagatatttagaatgaataaattaaagggtagtggtaatatggttattgttattgtagataatgtggtatttatatatgggtattagttgttttttttatggggtttaggaataagggtaagtttgattttttattatgaattattggggtgttttttatatatagaggttgtattagttgaaaatagtttaaatattttgtaattttgttttttttaatttttgtttatttatattttagaataaaagagtttgtttagtttttttaaagatttaaagaatattatttatttgttttttaagtatttaaaaagtataatcgtttatatttattttggttggatgaggatatgtatttatttatttatttaagagatatttattgttagatttggtggtttacgtttgtaatttcggtattttgggaggtagaggtgggaggattatttgaggttaggagtttaaggttagtttgggtaatatagcgagattttatttttataaaaaataaaaaattagttgggtatggtggtatgtgtttgtggttttagttatttgggaggttgaggtaggggtattgagtttaggagtttaaggttgtagtgagttataattatattattgtattttagtttgggtaatagagtgagattttgttttaaaaaaaagaaagaaaaagaaaaagaaaaggggtatttattgaatatttattatgttttaggtattgtgttagattttaagtgaatattagtatatgaataagataaaggcgaaaagttattaaataagtttaagttgatttcggtatatgtatttttttgatttttggtttcgtgttttgattataattttttattattagattagatttttttaaataaataattatttttgtatgttggggatgggttgtgtgcggtagtatttacgtaggcggtatagatagtagttttttatttaatgttgtaataatattaggttaaataatgtgtattgattttaaaagtgtggggttaggttttttttaagtgttatagggagagtgtaaagtaggaaaagtttatcggatgaggaaatattgtagagggaaagtgaatttttttttaatttgggttaaaatttagatgtggaattttatttttttttttatttttggatttttagataggaggaatttagtatatagataattatgaattatatatattttggttttatatgtttagatttgtttagagtatgaaatttttgttttgttggaaggtagcgtcgtgtttacggaggtatataagtatttgttttaaagttattttgatttgtagatttgtaaatggtaaaaataattttatatgtttgttttgatttgtttttatttttaggttattttgtgtgagttttattttttagaatgtgattttgtagttttgaaatggatattatgagtagattgagatgtgagaatatgttagaatgattataggttcggatgttagtggggtaggagagggagtttgagattgtattggtttatattgtggtttttggttgagtatttggtttgtttggatgatgttttggttttatttaatttttattattttattatttagaggatagaggatttgagttttatttttgtattgtagttattttttttgggatttgtttttaagtttttttttgtgttgtttggtattttttttttattttttttaaattatttattgttattttgtaagttcgattgatttgttggtttttttatgagattggaatttttttgagggtcgggataggtttattttttttattatagtgagtattagtttttagtttagttaatagttttgttaaataaataattgaataaaattatttgttaaataatggtttgttttttttagaggatggatttagtttgttttttttagaggatggatttagtaagtttttaattttggttataatggtgttagaaggaaagagttaagttatttggaggaaataggtttatttaaagatttttttttttttttttttttttaattggtaaaggtaggataagtgtatttgagataaattttggatataaaattttgatatattttttaggtattggtcgagatgttttggatttgaaagggaagtaaattaaattattttaggtttttttttttttttttttggagatagaattttgttttgttgtttaggttggagtgcggtggtacgatttcggtttataggaatttttgtttttcgggtttaagtaatttttttgttttagttttttgagtagttgggattataggcgtgcgttattatattcggttgttttgtatttttagtagggatagagttttattatgatggttaagttggtttcgaatttttggttttaagtgatttattcgtttcgggtttttaaagtgtaggaattataggagtgagttatcgtatttagttaggttttttgttaagtggtttgagatttagttgtgaatggtagttatggttagatttaggaatttaaagtttgatttattttgtttgaagttaatattaataataagagagatgtatttggttttataatttttttttttttcgtttttttttttttttttgtaattaaggatagaattagaagtatcgaaggtcgtagaattgttttaggatttagagtagttttaaggaatttgtgtttacgtattatgtgtgttttttcgtttttttttttttttatgagtgagaaaaaaaagcgtttaaatttttattaatataaattaatgatatataatgatgaaattttgtttttatttttgtttgtgatagggaatgtaaaaatagtaagtggtttagttttacgaattttcgttttttgtttttttcgtttttgtcgggttggatttttaagaatggaggttagcgtatagtttcgcgcgggtcgtttagttttcggattcggcggatgatgttaggcgacgggagcggtcgcggtcgggtcggggaggtcgcggtttaggggagttgggagggagggtggtttcgttaggtcgacggcgcgttcggtcgcgcggcgttgtttggagacggttttggcggcgttgtgttgttgtaaatagtcgtttttttgttattatttatagtaggattttttggttttcgggcgcggcggttggaggtaggtttgcggttcggtttttcgcgcgtttcgaattattcgttcgtcggttttattttgtttcgtttttttttaggtgtttatcgcgggtttcgattttcgggttcgaagagtggagaagggaagatcggggttgtgcggggatatgcgttttcgcgttttggaggtggttagcgcgttggggttgagtttcggtagcgtgatttcggttgttttacgtagtagggtaggagattggggggcgtggtatattttggagtattttgtttttttaaagtttcgtgttttaggacgtggagtcgtttttggggttttagtagtcgaggtatttcgtttaggcgtagttggatattgtttttttagttttcgttttttattttttaagttcgcgttggaaaattattcgttgcgggttttcgtaagtatagttttttggcgggatcgaattagtttttagcgtagatttgagtttttcgtaggaagtatatttcgttttgttatttcgaattgattattttgtttatataattatatttcgtattttttatttttggggtttagtttagaatcgggtagatattttttttaaatgttttcgtacgtaggttttgtatagtgtttatttgttggtgttttagggatttgatagtttttttaatatttttatatatggtcgagaaaaataaataaataaatgcgttgttttttttaaaaaaataaataaataaagtatttagtatcgtaaagtaggttatcgtatttttttattttggattttttattttttgtttttaaacgtaggaatagtgttagtattgttcgagttcgagggttggaggttaggggatgaaggtttgtttttacgttttgtattgaattagggttagaattggggatgggggtaggggcgtattttttcgggagtcgaggtttaagttttcggggttttgtattcgatgtcgttttttttatttttgagttttagaattgtttttagttttcgtataagggtaaaaaggcgttttttgttttatttttttcgatttcgggaataagggttcgtattgaattaggtgcgaatgtttttttttattttgcgtcgttttcgtttttttttttttagtcgcggttttcgttttttttcgtattgtattttcggtgttggttgtagttcgcgagtagttttcgttaatttttttttttttatataggatgtttatattaggatatttgcgttagtaggtttttacggtttttttttgtagttttggggggagttattttcgaaattttttattttggggggtttacgagatttttgagataggaattgcgaaatgtttacgagattaggatacgcgttaaggcgggggtagggagttgcgagcgttggggacgtagtcgggcggtcgtagaagcgtttaggttcgcgcgttatttttttggcgttatcgtggttgagttcgtgacgtttatatttatttataaaacgtttgttataaaagtagtggttgcggcgtttcgtattttaatcgtatttgtagcgagtatttgagaagttaagattgagtcggcggtcgcggcgtagcgaacgagtagtgatcgtgtttttatttagttttgttttatagcgtttatttgttttcgtttttcggtttttcgttcggttttgtttaatcgttacgatgatgttttcgggttttaacgtagattacgaggcgttattttttcgttgtagtagcgcgttttcggtcggggatagttttttttattattatttattcgtagattttttttttagtatgggttcgtttgttaacgcgtaggtaaggttggtttttcgtcgtcgcggggtcgggggtttggggtcgcggaggaggagatatcgggcgggacgttttagtagatgagtagggggtttttttgtgtttggagggaggttgtcgtggtcggagcggtgtcggttcgggggttcgggatttgttttgagcgtacgtacgtttgttatagtaagaattggtttttttttcgggaggtaggttcgttttgagtaatttttggtttgtattttaggacggatttttgatattagttggagtagacgtgttttaagtataaattcgttaattagagtttggttttttcggggaggtggtagaaagcggtaattttttttttttcggtagtttggagtacggaggagggatgagggaggagggtgtagcgggcgggtgtgtaaggtagttttattgataaaaagcgagtttattttggagatttcggagcggcgtttgcgttagcgtagacgttagggatatttataataaatttttttttaagtaagtgatgttgaagggataacgggaacgtagcggtaggatggaagagataggtattgcgttgcggaatgtttgggaggaaaagggggagattttttatttaggatgagggatatttaagatgaaatgttcgtggtaggatcgtttttttttattgttgtatgcggtattgggaattcgttttatttgtgttcggaatttgttcgtttacgtcggttttttttttttgttttgttttagg

SEQ ID NO: 50 - DNA, 6050 bp, Artificial Sequence
  Chemically treated genomic DNA (Homo sapiens)
tttagaataaaatagaaggggaaagtcgacgtgagcgagtaggtttcggatataggtggggcgagtttttagtgtcgtatgtagtagtgaagagaaacgattttgttacggatattttattttaaatgttttttattttggatgaaaggttttttttttttttttttaggtatttcgtagcgtagtgtttgttttttttattttgtcgttgcgttttcgttatttttttagtattatttgtttgaaagggggtttgttataaatatttttgacgtttgcgttgacgtaggcgtcgtttcggagtttttagaatgaattcgttttttattaatgaaattgttttatatattcgttcgttgtattttttttttttatttttttttcgtgttttaggttgtcgggggaggggggattgtcgttttttgttattttttcggagaagttaggttttagttagcgagtttgtgtttgggatacgtttgttttagttaatgttagagattcgttttggagtgtagattagaggttgtttagaacgaatttgtttttcgaagggggaattaatttttattatggtaagcgtgcgtgcgtttagagtaagtttcgagttttcgagtcggtatcgtttcggttacggtagtttttttttaggtataagggagttttttatttatttattggagcgtttcgttcggtgttttttttttcgcgattttaagttttcggtttcgcggcgacgggaagttagttttatttgcgcgttgataggcgagtttatgttggagaaggagtttgcgggtgagtggtagtaagagaggttattttcggtcggggacgcgttgttgtagcgggaggatgacgtttcgtagtttgcgttgaagttcgagaatattatcgtggcggttaggtaaagtcgggcgaggggtcgaggggcggagataggtgggcgttgtggagtagagttgggtaggagtacggttattgttcgttcgttgcgtcgcggtcgtcggtttagttttggttttttagatgttcgttgtagatgcggttggagtacgaggcgtcgtagttattgtttttataataagcgttttatgaatgagtgtaaacgttacgggtttaattacggtggcgttagaggggtggcgcgcgggtttgggcgtttttgcggtcgttcggttgcgtttttagcgttcgtagttttttgttttcgttttggcgcgtgttttaatttcgtgagtatttcgtagtttttgttttagaggtttcgtgggttttttaagatgaggggtttcggggatggttttttttagggttatagggaaaggtcgtggaaatttgttgacgtagatgttttaatatggatattttgtgtaaggggggagggattgacgggaattgttcgcgggttgtagttaatatcgagggtgtagtgcggggggaggcgggggtcgcggttgggggaggggaggcgggaacggcgtagaatgagagagaatattcgtatttggtttaatgcggatttttgttttcgaggtcgggggggatggggtagagagcgtttttttatttttgtacggaaattgaagatagttttgaggtttagagataggagaaacggtatcgagtataggatttcgaggatttaagtttcggttttcgaaggaatgcgtttttatttttatttttaattttagttttaatttagtgtaaagcgtggaagtagatttttattttttaatttttagttttcgggttcgagtaatattagtattgtttttgcgtttggaagtagaaagtggaggatttaaaataagagaatacgataatttattttacgatattgggtattttatttatttatttttttaaagaagatagcgtatttatttatttatttttttcggttatgtgtgggaatattaaggaaattgttaaatttttgagatattagtagataaatattgtgtaaaatttacgtgcgaagatatttgaagggggtgtttgttcggttttgagttgggttttaggggtagggagtgcgaggtgtggttatgtgggtagggtggttagttcgggatgataaggcggggtgtgttttttgcggggaatttaaatttgcgttgagggttggttcggtttcgttaggaagttgtgtttacgggagttcgtagcgggtgattttttagcgcggatttggagggtggaggacgggggttggaaggatagtgtttagttgcgtttgggcggaatatttcgattgttgggattttaggagcggttttacgttttggaatacggggttttggggaggtaaggtgttttagagtgtgttacgttttttaattttttgttttgttgcgtaggatagtcggggttacgttgtcggggtttagttttagcgcgttggttatttttagggcgcgaagacgtatgttttcgtatagtttcggtttttttttttttatttttcgggttcgggggtcggggttcgcggtgggtatttggagaggggcgaggtaggatgaggtcggcgggcggatagttcggggcgcgcggggagtcggatcgtagatttgtttttagtcgtcgcgttcgggagttaggagattttgttatagatagtaatagggaagcggttgtttatagtaatatagcgtcgttagggtcgtttttaggtaacgtcgcgcggtcgggcgcgtcgtcggtttggcgaggttatttttttttttagtttttttgggtcgcggttttttcggttcggtcgcggtcgttttcgtcgtttgatattattcgtcgggttcgggggttgagcggttcgcgcgaggttgtgcgttaatttttatttttagagatttaattcggtaggagcggggagggtaggaggcggggattcgtggaattgggttatttgttatttttgtattttttgttataggtagaggtgaaaatagaattttattattgtatgttattggtttatgttggtgggaatttaggcgttttttttttttatttataaaaagggagggaaacggaaaaatatatataatacgtaaatatagattttttggagttgttttgaattttaaagtaattttgcggttttcggtatttttaattttatttttgattatagaaagaaagagggggacgggagggaaaggggttatgaagttaaatatattttttttattattaatattagttttagataaaataggttaagttttgaatttttgagtttggttatgattgttatttataattagattttaggttatttaataggaaatttgattgggtgcggtggtttatttttgtaatttttgtattttgggagttcgaggcgggtggattatttgaggttaggagttcgagattagtttggttattatggtgaaattttgtttttgttaaaaatataaaatagtcgggtgtggtggcgtacgtttgtagttttagttatttaggaggttgaggtaggagaattgtttgaattcgggaggtagaggtttttgtgagtcgagatcgtgttatcgtattttagtttgggtaatagagtaagattttgtttttaaaagaaaagaaaagaaaatttagaatgatttgatttattttttttttaggtttaaagtatttcggttaatatttaaaagatgtgttaagattttatatttaggatttattttaaatatatttattttgtttttgttaattaaaaaaaaaaaaaagaagaagggtttttgagtgagtttattttttttagatagtttaattttttttttttggtattattatgattagagttggagatttattaaatttattttttggaaaggataaattaagtttattttttggaaaggataaattattatttaataaataattttgtttaattatttatttaataaaattattgattgggttggaggttggtgtttattgtaatgaagagggtaggtttgtttcgatttttagagagattttagttttataggaagattaataagttaatcgagtttatagggtagtagtaagtggtttgaaagaggtaagaaaggggtgttaggtaatatagaagaaggtttggaaataggttttagaggaggtgattgtaatatagagatggggtttagattttttgttttttggataatggaatgataaagattgagtaaggttagagtattatttaggtaaattaagtgtttaattagaagttatagtataggttaatataattttagatttttttttttgttttattaatattcgaatttgtgattattttaatatatttttatattttaatttgtttatggtatttattttaggattgtaaaattatattttaaaaagtggagtttatataaggtagtttaaaaatgaagataaattagaataaatatgtgaaattatttttgttatttgtagatttgtaggttagggtgattttgagataggtgtttgtgtgttttcgtgagtacggcgttgttttttaatagggtagggattttatgttttggataagtttgagtatataaaattaaaatgtgtgtagtttatgattatttatgtgttgagttttttttatttggggatttaaaagtgaaaaggagggtagaattttatatttgaattttaatttaaattgaaaaaaaatttattttttttttatagtgtttttttattcgatagattttttttattttgtattttttttgtggtatttgaaggagatttgattttatatttttgaagttagtgtatattgtttagtttggtgttattgtaatattaagtgaaaggttgttgtttgtatcgtttacgtaaatgttgtcgtatatagtttatttttagtatgtagaagtagttgtttatttggggaagtttggtttagtggtgaagggttgtggttaaagtacgggattagaagttaggaagatgtatatatcgaaattaatttagatttgtttggtaatttttcgtttttgttttgtttatgtgttgatatttatttaggatttagtatagtgtttgaaatatagtaggtgtttaataaatatttttttttttttttttttttttttttttttttgagatagggttttattttgttatttaggttggagtgtagtggtgtgattatagtttattgtagttttgaatttttaggtttaatgtttttattttagttttttaagtagttaggattataggtatatattattatgtttagttaattttttattttttgtagagatggggtttcgttatgttgtttaggttagttttaagtttttggttttaagtgatttttttatttttgttttttaaagtgtcgagattataggcgtgagttattaggtttggtaataaatattttttgaatggatgaatgaatgtatgtttttatttagttaaggtgaatgtagacggttgtgttttttgggtatttagaaagtaaatagataatgttttttaaatttttggaaaggttgaataggtttttttattttgggatatgaataggtaaaaattgggaaagataaaattataagatgtttgggttatttttagttggtatagtttttgtgtataaagaatattttagtggtttatgatgaaagattaaatttatttttgtttttgagttttatgagaaagatagttagtgtttatatataaatattatattgtttgtaatgataatgattatgttattattattttttaatttatttattttaaatgtttggatttaataagagaaagaggtattttataatttttgtgggatttatatatacgtgagtttagtgaagggttttaggaggtcgaggttatttattcgatggtttagatcgtgagtaaaaagattgtttttatttagaatattggaggtataagattattatgttattttttttttatatatatatatatgttattattgtaattaattagtattagagatttagtttttttgagaaaaattgttttttttttttgaataatttttggttttttgataggagaggatg

SEQ ID NO: 51 - DNA, 14147 bp, Artificial Sequence
  Chemically treated genomic DNA (Homo sapiens)
gggggtattgagtaatatatttagattaataatattttataagtgtgagtattattgatttaaatttttttgttggttgtgttttgtgtttatgtttgttttatatttattttttttagagttgttttttttagagttttagtaatttttatttttttaaatttttttagttatgggaaggattagtaggtgttagtggatttaaaagaattttagatttgttgagatttttgatttttggtgtttagattaattagtaaatagtttaattaaacggtttgtttttatggttaatataattttgaattggtggttatttagattaagtttattttgtttttgagacggaattttgtttttgtcgtttaggttggagtgtagtggtgcgattttggtttattgtaatttttgttttttgggtttaagggatttttttgttttagttttttaagtagttgggattataggtatttattattattttcgattaatttttgtatttttagtagagatagggttttgttatgttggttaggttggttttaaatttcgattttagatgatttgtttattttagtttttttaagtgttgggattgtaggtgtgagttatcgcgtttagttaaagtttagtttgtataagaaggttttttttgttatgttataggatttttgagtttattaaatagattttaatgttttgagattttacgtatttttttaaaatgaagtatttaaattgttagtgtttgtttttttgtttggtttttttgatgtattgatttggtttgttagtgtgatgaaaaatatggttgagttttattgttttattgtaattagtaggattgtttagaagtttaatttttttaagagatgaagatttgagtttatgtagttggttgttttttaaaaatatttggttatttgggatatattttgaattaattttttggttattttatgtgattaaaagtgttagttttttttgtttttagtatatttttttgtttgggaagtggaagggatgaaatttttatatttttttttgatgatatagaaaggagtatatatttatattttatgaatagatatgtaattatagaagaaatagtttaacggtcgggcgcggtggtttatatttgtaattttagtattttgggaggtcgaggtgggtggattacgaggttaggagtttaagattagtttgtttaagatagtgaaatttcgtttttattaaaaatataaaaaattagtcgggaacggtggtaggcgtttgtaattttagttatttaggaggttgaggtaggagaatcgtttgaattcggagggtggaggttgtagtgagtcgagattacgttattgtattttagtttgggcgatatagtgagattttattttaaaaaaaaaaaaaaaagtataattatatgattatttatattgttttatatattaaattagtagtaatttgttttttatatagtaaataaaaataaattagtagtaataaatatattttttttgtgttatagttagtatttggtgaattttgtattttttttttttttaaagtgttgaatttataggtttttataaggtaagtttatattattaattaattttgtttttttttttgatgttaaaattgttttttaggagttgattaggtttatttttttgttttttaagtattatttttagaatatttttgaaagtatttttgttttttggtaataatatttatattttatttattttttgtttttaaatatatatttagttaattttaggttttttttaatggagtagttatttatttatttaatatacgttgggtgttttttttgtgttatatattgttttggtttttggggatagagtaggaaataaaaaaaaataaaatttgtttttatatagttgatattttagttaggggagataaataataaataaatgaatgatgtagtatgttagatgttgatagtgttatggagaaagtatattatggagattagaagtattatttgtaatggaatagttatgattttaagaagaatggttgattggatgtgaagtgtgagagagaggagtttaggtttttggttgagtaattggagggatggagttgttattatttgagatggagaagttaggggaggagtagatttggaggggaaggttaggaatttagtttggaatttgttaagtatgaggtatttattaaatattgaagtggatttttagaagatgttattaaaattagttaagtttaggagagagttttgggttagaaataaaaatgtgggagatattggtatatatatgggtttatattatttttttttttaatttaatattttattttattgttttttgtttttttaatagtatttagttttatttattttttaaattgatttttatattgatagtataataaaatttatattttttattatattaagattttgtgtgatttaatttttttttattttttggattttgttttaggttattttttttttttatttaatttttaatattttgattttattgttttttaaatagttttttgttgttttttgttttttttgtggaaaaggtttttttattgtttaattattaggtatttttcgatttttttttattttttatttttgagaaaggttttttttgattttttatattaattaggatttttttgggcgagatttgatttaaattggtttagagaaaaggagttaattgattggtttatgtaatttaattttttttttttgttgtaatttttttttggtttttattttatttaaggttaaagttagggtttttattatggttttgtaggttttatatagtttgttttttttattatttttttgattttattttttatattttttttttatttatttttttttagttagagtggtttttttgttgtattttaaatatgttaggtatatttttattttagtgtttttgtgtttgttgttttttgtgtgtggaatatattttttatatagttatattatttaaaatttattgtttttaagtttttatttaaatgttttttcgtgaagttatttttgagttttttttaaaattgtagttttttatttttgtattttttattgttttttatttttaatttttgttattgtagttagaattatttgatatatagtttttattttattggttttttgttatgtttttttttataagaatttgaagtttattaggtcgggagttttgtttgttgtgtttgttgttattttttagtgtttaaaattgtttggtatatagtaggtatttaataatttttgaattagtgaaaattagatggtggtttggtatttttatataggaatgagttaggtggaaattatttaggatataagtagattttgaagtgataaggaagggttattataattatgtggggtttattttgtttttttttgttttttttttttaggtttagtaatagttttattaaggattttatgaatattaaagtttatatttatatgttgttagaggtgagagtagtttattttattattagattttgtgtttagggtggtgatttgaagaaggaagagagcgaaagaagggaaggattatttttttttttaaattggagttaagggagggaggttagagtaagtttgggggcgtaatttagatttagtttttgtttaattttttttgtttttttttttaggggtttagagaattataaggtttgtagaattttttagagaagttttattattgattttttttttttatttttagatattaaagagtttgaatgtttttgagttatatggtttttttttttttttataaattttgttagttgttacgggggtttgtttttagggtataaagttattgagagatttagagatttagtttttttgtggaatttttaaaatgttttagtagttttgtttttagtttgttgtttggtagtatttgttagttgattttatgtattgtttttttttttgttattttggtaatttgggttttttattttatttttttttttatttttttttttagacgttattttttgaattgttatagagaatgggttaatttatggtggaggtttgtttatttttataataattaaagggttttaaggtttacgtttttatatatttaattattttttaggtattttaaattatatttaaattttaatttagttttattttgttttagtttttgtttgtaagtgttttagtttttaatgggtatagatttggatttcgttttttttagtcgggtttttattttaggttgagtttagttatcgttaattaatgtagagttaggttttttttttttttaattttggtcgtagtttaattttgttttttgaaagtatttcgtttttgttatttaatgttttttcgtgtgtttgatagttattttgtttttttattttcgttgtgttttaaattcgtttttatttagttttatggttttgtttaatcgtagagttgttttgttcgtttacgcggagtttagttcgatttattttcgtcggttgttacgtttatttttatataagttttgttttcgttgagtagtatggcgtgcgatatcgtttttttggtgttttggtaggggtttagaagtttttcgttcgttaattagagaaaaatagggttatttattttcgtttttgggggttgttttttattaattttatgtaagttaattagtgtgaggtagattttcgttttttcgatataggtttcgagtttttttagttgtttatagttcgttagtttttgagttaatcggcgtggagtatcgtgaaggtcgaacgcgttttttcgggattttaggggtcgtgagcgttttattatttttttttacgttaattacggtatagttttgtagggaagggttcgttttttaatttttcgaggttttgcggtcgattaatagcgttttggttaattagcgagcggcgggatattgggtttttttttttcgggtttacgtgagttgtagggaaacgtaggggcggtttttaggtgttgtcgtcgttatcgttattattatttttatcgtcgtttcggaatttaggtttggggggcggtggggtcgcgtatggagttttcgtttttcggagttgttaatattgttaacgttatcgttacgttatatataggtgagttttgggtttggagggtggagggtttagttcgtgattttacgtatttttttcgttttcgcgtagaggatgtggtttggtcggtggtttgttggtgttcgatttttcgtcgttattattacggttggtggatttgcgtgtggtattgtttaagtttttcgttttttatagtggatttgatcgtggtttaatttttttttttcgttgtataatggatcggtttgcgtgtttatgtttttttttacgttaatttagggtggattcgtttataggttttttttttatttttatttttattcgttttttatttatttttatttatagggagttagtttgtgatagtgtttagtttttttaatagtaggtgtatttgagtgtttggattttttttagttttaatttttaggagattcgttcgtggttttatttattttattttttttgtatatcgtagcgaattaattcgtggcgtcgtattttttcgtatttttttttaatagtgagtttatttgagtttgtatttttgttttttttagttttttaatgtattagtttatggttttttttaaaattattttttttttttattattattattattattttatagtggattagtttttatgtttggatttacgtttttttagttattagtttattgttttgttttttttttttcgtagattgtcgttttagcgtttggggtttttttttttttaatagtgggttagtttagtgttttatatttttttatttttagtagtttagtttatagttttttttttttttgttttgaattagtttgtgtgatggtttttttttttttttattgtggtgtaggagtttgtaaggttttttgttttttttttttttagacgatgagttttattatttttttttttgtagtggatttgtttattggttttttttttttatatttttgtatgtttgtatagtttttcgtatattttttcgtgagtttagtgttttgtaattgggggaagatcggtcgtgtatttttaatttttttttttttttttttttttttttagaagagaacgtgttgatttttttttttttgtgatggagtattgtacggttttttttgttttttattttttaatagtgggttagtttggttatattcgtaattataaagacgttttgttttattataataagtgaatatattagcgttagtgatgatagtaatgttaataggagttagcgtttattgagtatttgtcgtatattaggtagagtgttttatatgaatgagtttttttaatttttattataattttatgagataggtagtgagggaattgggttatagggaggttaaattttttatttaaaggtggtttaggaagtatttaggatataggataatttttgaggttttttttttagattttattttattttacgtgaggttttagtttttaaaaattaaattagtttttatttttaagtttttgtttttgttgttttttttgtttgtagagtagtttttattttttatttttttttagtatttatttattttttaattttagtagttgtgtgattttagatgagtgatttaattattttttttttgtgtttttttttttatttgtgaaatgggggattagaattagaattttttttagtgtaaataaatattaattgtgaattaatggtaaaataagtaatttttttagtattatcgtttatatttttttatttttttattgtgttttaattatattggttttattatatagttttttaaatatagtaggtatgggttagttttagggtttttgtattggttgttttttgtgttttgaatattatttttagatttttgtatggttttttttagtattttgtttaaatattaatttttaaaggatgtttattatattgtggtgtgtggaatgtagtataaaaagatatatgtatgaaagatgtttttaagaatgttagtttatatatgagtaagggttttttttttttttaaaaggatgtgtttataagattgaggtacgtaatatgttttgtaaaggtataggtataaaagttgtttttaagagtgttagttgtatatgtgaataaggattgtgttgttgtattgaaagaatgtgtttataaaattgtggtgtgtagttgggtataggggtgtgtatttatagttttagttattcgggaggttgaggtgggaggatagtttgagtttaggagttttaggttagtttgggtaatatagcgagatttttttttttgaaaaaaaaaaatttaaaaaataattattgtggtgtgtgtaatatatttttttaaaggtataggcgtaaaagatgtttttaagagtgatttgattttgttgtatttgggtagtgttattttattaaaggttgattgttatattatggtatttagaatatattatataaaggtatatgtataaaaaagaagtttttaataatgttatttgtaaaaataaaaaaagttaatttttttttgattatttgaagttgtatatttagtagggtttaagttaggtttttgatttgtttcgttgttttttattattgtttgatatattgtgtgggttatttgtttgttgtttgtttttttttattagaatgtgagttttatgaggatttagtttttgtttgtttatttatcgttatgtttttagtaattgaaaatgtattaggtaaatagtagatgtttaataagaatttattttatgaataaatgggaaaaagataatttgagatattagtgtaggggttatatgaggaagaagaagggatatgagagttaattagttgggattgtttttgtaattaatttttattgagttttttgtgagtattaggtatttttttaggtgttggaatatggtaaggaacgaaatagggcgaaatatttgtgtttgtggagttgatatttattaaaagttggggaggttgggtacggtggttaatattagtaattttagtattttgggaggttgaggtgggtggattgtttgagtttaggagtttaagattagtttgggtattacggtgaaattttatttttattaaaatataaaaaaattagttgggtgtggcggcgtgcgtttgtaattttagttatttgggaggttgaggtaggagaattgtttgaatttaggaggcggaggttgtagtgagttaagattgtattatgtattttagtatgggtgatagagcgagattttgttttaaaaaaaaaaaaaaaaaaatttaagttggggagatagattatgtgaataaaataaataagtaaaattagtataatagataaatgttgagaagaaataatgaaatagggtaggtaggaatcgagtattgggggtggttgaaattttaggtatagggaaggtgatttttgaattagggttttacggtagagacggagagagttttaatgtttacgggaagagtatattaggtagaaggaagtgttagtttagaggttttgaggtgggatggtgtttgttatgtttaaggaatattaaggcggttagtgtggttggagtagagtgcggggaagggtagaaggtgaggttatataggtgatgggagttagatagtgtaggtgatatataggataggattgtaggggtagggggagaaggatgatatattagttaatagttaatatttgtggagtatttgttatatattagaggtatttttttgtttaaatattaatttttaaaggatgtttattatacggtggtgtttggaatgtattataaaaagatatatgtgttaaagatatttttaagaatgttagtttatatatgaataaggattttttttttttttaaaaggatatgtttataaaattgaggtatgtaatatgttttatggaggtataggtataaaagttgtttttaagagtgttagttgtatatgtgaataaggattgtgttgttgtattgaaagaatgtgtttataaaattgtggtgtatagttgggtatagaggttgaggtgggaggattatttgagtttaggagttttaggttagtttgtgtaatatagtgagattttcgttttcgaaaaaaaatttaaaaaataattattgtggtgtgtataatatatttttttaaaggtataggtataaaagatgtttttaagagtgatttgattttttggtatttgggtagtgttattttagtaaatatttattgttaaatattatggtgtttggaatatattatataaaggtatatgtataaaaaagaagtttttaataatgttatttgtaaaaataaaaaaaaaagttaattttttaagttttttatagaagtattttatagaattgatatagttaatttttatagaagttttggagggtaggtgtatttttgagaatatttgattttgagagtaaaatatttttattttatagatgaggaaataagtaaagagaggttgagtaatttgtttagggtaattttgagttagaatagttagaataggggtagaggaatataaggttgaagatttagaaagaagaatagatttgtaagggtaggtaggttatttggtatttttgattacgtagaggaagaatgaattttttttggaatgcgatgattgtgtaattgagtttatgaagtgagggaagagttttttttgcggggagagtagttcgtgtttatttttagaggttggaattgtttcgggaacggtagatagtttagggtggttgttttagagtttttgtatacgtcgttcgtttcgtttgaaggtttttttttatagagggtagtttggtttgttatttttttttttttaggttaggtgttatttttttggggaagaattttttgtatattttgtgtaaaaatagtatttttgttattttttaggattttatttttttttgtttttttttatggagaattggtggtgtaaggcgattgtttattagagttaaattatttaggttttgaatttcggttttgttaatttttagttgtgtgatttggggtaggttatttttttgtatttttattgttttatgtggaaaatgggggaaatgataatttttattttttaacggtggtttgaggatttaatgagttaaatgatttaaagagtgtgtagtttacggtaaggatcgtatgtttggtttgtatttttaaattattaaaatgtatttatagtatattcgtagatgtttgataggtttttgaaattgattatttttaaaattggtgtgattttttttaaaatttatttttttgtaaggtttttattttagttgattataatgttgtttttgtgggtgattaggttataaatttagatttattttggattttttttttatttttttcgggtatgttatttgttagtaagttttattttgtgtttaggttttttttagattttagttatttttcgttagttttattgttattattattatttatcgtagtggtttttttagttttaatagtttgttttttttataatcgttagggggattttgttgaaattttagttatagtttgttatttttttgtttataatttttttgtggtttttgttttatttaatattttgatagtattcgaaaaagtttggtttagtttggttttcgttattttgtttttttttttcgttgttttttttttttttttcgaatttatgttagttttttttttttatgttatttgttaggtattttttagttttgggttttttatatcggttgtcgtttttatttggtttgttgtttttagatatttacgagtttagtttttttatttttttttggtttttgtttagttgttttttttttggcgattatttttttttgattttttatgtaaaagtaatagtttttttttgtttgattttttttttataatttttattattatttgacgtatttttgtatatgtttgtttttttttttatttgttttttttgttaagatgtgagtttttttggagtagggattgttgtttgttgcgttttcgattgtattcgtagtatttggtttatagtatgtatttattaaatgtttgttaagtgaaggagatggaaagaagtaaatatatttaagtaaggtagattattagaatttttatgaggggttaagtgggagaaataataaaatataaagttttgtgtgttgttgaagttggaagtttatcgttattttttatttagttgataggttttgttgtagttgaaagaagaattggtaaaattgtttgtttttgttattaggagttattttgaattttttggatttttgaaataagtttgtttgtaaaataaatttagtgaggtttttggtgataggattttttaatcggatattttatggttttgtgatttgtataattgaataggaagtttatgtttatttttagtttgtttttaggaaagaaagtagtaatggggtgatagggaggattttgttttttgaaggatatgttgagagggaatagtcggtgtgaggggtcgtttagtttaatggtgaaatgtttagttaattggaatttgattgtttggttttaaatgttggttttgttatatgtggtttgtggaaggtacgtagatatttgtgttttcgttgttttatttataagttaatgataggaagattatttattttttagaggtatgattagggataaataagttaatgtttattaaaaaaaaaaataatagtataggtgtatatgtttttatttaaaatttttggggttagatgtgttttagaatttttatttttttatattttagaaaggtaatatgatgtatatacgatgttatataatattttttagtaagttttgtaatcggttgtgtttatatttttgtagtaaaatgtatgaatattcgtaataagtgagatttaataaagattagaaagggttttgttttattttaaattaggttttgttattaaaagagttaaaagaagttttttgtttttagagtattttggatgttggaatggtagataagggattatgaataaattagaaattaatatttagagtttattatatattttaggtatataatatttaatttgtataatatttttgtgaattaggtattgttatttttattttattaatgggtatattattatttttgttttatatatgagaaaattgaggtataaagaggttaaagaatattagttaagcgtggtgttttatgtttgtaattttagtattttaggaggttagggagagaggattgtttgagtttaggagtttaagaatagtttgggtaatatagtgagattttattttttaaaaaaagaaaaagaatatgtttagggttatatagttaataagtggtagaattaggatttaaatattggtaatttggttttagtgtttgggtagttgtttagtaggttatattgtttttttgtttagaagagtgtttgatgtgtattaagtttttaatagatgttaattattgttgttattaagaaagagaatatttagggtcgagtacggtattttatatttgtaattttagtattttgggaagttaaggtgggaggtgggtggattatttgaggttaggagtttaagattagtttggttaatatggtgaaattatgtttttattaaaaatataaaaattagtcgggcgtggtcgtgggtatttgtaattttagttatgcgggaggttgaggtatgagaatcgtttgaatttgggaggtagaggttgtagtgagttaagattgtgttattatattgcgttttagtttgggtaatagagagagattttattttaaaaaaaaagaaaaaaaaaaaaagaacgagaatatttagggatagtaataggatagagagattaggtatttatttagttttaggacggttttataaaggaaaggatttttgggttgggatttgaaagataagaaagattgttaggcgaaagaaggaagttttacgtggagtgagtagtttttgtaagggtttggtaaaaaaaaaattttttgaaaaatttgatattgatatggtagaagatatagataatatttaaatgaggaggatggaattagttttttatttttgttgtaataaataattataaatttagttgtttaaaataatatatttgttattttatagttttgtaggttagaagttttatattggttttagttgaaattaaggtattggtagggttgcgttttttttggaggttttaggggaaaatttattttttgtttatttaagttgttggtagaatttaattttttgagattgtaggattgaagtttttgtttttttattgtttgttagttgatagttatttttagttttaagaggttgtttatagtttttgattttgagttttttttttttatttttaaagttaataatggtaggttgagttttttttatattttgaattttttttgttttttttgttattatatttttgagttatttttttttttttattatttgttttttagagtttatatgattagattgaattttattaaataatttagaaataatttttttgttttagggtttgtaattttaattttatttgtaaagtttttttttgttatgtagtgtaaataatatataggtttcgaggattaggatgcggagtagggttggtattatttggtttattatagtttgttttttgatttttatagatttatatttgttttatatttaaaatatatttatattattttaagatatttatgagttgtattttattatagggagtattttaagtaagattggggagttagaagttagtttgggaaggtttagggaatgatggtagggtttgaagatagagatggagaaaagatgataaaaaaaggaatttttttttcgttgatttttgttttttttatgtttatagttttttaatttagttgtttgttttttagg

SEQ ID NO: 52 - DNA, 14147 bp, Artificial Sequence
  Chemically treated genomic DNA (Homo sapiens)
tttggagagtaaatagttgagttgagaggttgtggatataggaggggtagaggttagcgggaggaggatttttttttttgttattttttttttatttttgtttttaaattttattattattttttaaatttttttagattaatttttagttttttagttttgtttgggatgttttttgtgatgggatataatttatgggtattttaggatggtgtgaatgtattttgaatgtgaaataaatgtgaatttgtgggggttagagggtagattgtggtaggttaaatgatgttaattttgtttcgtattttaattttcggaatttgtatgttatttatattatatagtagaaaggaattttgtagatgaaattaaggttataaattttaagatagggagattatttttggattatttgatgaaatttaatttaattatatgagttttgaaaagtagatgatggagaaagaaaggtagtttagagatgtgatgatagaagaggtaggggagatttaaaatgtgagagggatttaatttgttattgttggttttgaagatggaggaaggaggtttagaattaaggattgtgggtagttttttaaagttgggaatggttgttagttgatagatagtaaggaaatagggattttagttttataattttaaggaattggattttgttaataatttgaatgagtaggaaatggatttttttttagagtttttagaaggaacgtaattttgttaatattttgattttagttgagattagtgtgggatttttgatttatagaattgtaagataataaatgtgttgttttaagtagttaaatttgtgattatttgttatagtaagaatagaaaattagttttattttttttatttgaatattatttgtattttttattatattaatgttaagttttttaggaggttttttttttgttagatttttgtaaaggttgtttattttacgtggggtttttttttttcgtttagtagttttttttattttttaagttttagtttaaaggtttttttttttatgaagtcgttttaaaattgaatgaatgtttgatttttttgttttgttattgtttttgaatgttttcgttttttttttttttttttttttttttgagatggagtttttttttgttgtttaggttggagcgtagtatagtggtataattttgatttattgtaatttttgttttttaggtttaagcgatttttatgttttagtttttcgtatagttgggattataggtatttacgattacgttcggttaatttttgtatttttagtagagatatggttttattatgttggttagattggttttgaatttttgattttaagtgatttatttattttttattttggttttttaaagtgttaggattataggtgtgagatatcgtgttcggttttgaatatttttttttttgatgatagtaataattaatatttattgagagtttaatatatattaggtatttttttaagtagagaggtaatatggtttgttggataattgtttaggtattagggttagattgttagtgtttgaattttggttttgttatttattagttgtgtgattttgggtatattttttttttttttttaagaaatggggttttattatgttgtttaggttgtttttgaatttttgggtttaagtaattttttttttttggttttttaaagtgttaggattataggtatgaggtattacgtttggttgatattttttaatttttttgtattttaatttttttatgtgtaaaatagggataatgatatgtttattagtaaaatggggataataatatttagtttatagagatattgtatagattaaatattatatgtttgaggtgtatgataagttttaaatattagtttttgatttgtttatagttttttatttgttattttaatatttaaaatgttttaagggtagaaagttttttttaatttttttggtggtaaaatttgatttgaaatgaaataaggttttttttggtttttattgaattttatttattgcgagtgtttatatattttgttgtagaaatatgaatatagtcgattatagagtttattaaggggtgttatgtaatatcgtatatgtattatgttatttttttgaaatgtgaagaaatggaaattttgaaatatatttggttttaggggttttgggtaagggtatgtatatttgtattgttatttttttttttaatgggtattgatttatttatttttgattatgtttttgagaagtaggtagtttttttgttattaatttataaatgaggtagcggaggtataaatgtttacgtattttttataggttatatgtggtaaagttagtatttggagttaggtagttaggttttagttgattaagtattttattattaggttaaacggttttttatatcgattatttttttttagtatgttttttaaagaataggattttttttgttattttattattgtttttttttttgagagtaaattggaaataaatatgagttttttgtttaattatataagttataaagttatgaagtgttcgattagagagttttgttattagagattttattgaatttgttttgtaggtaggtttgttttagaagtttaaagagtttagagtgatttttggtggtaaagataggtaattttattagttttttttttagttgtaatagaatttattagttgagtgaaaggtgacggtgggtttttagttttaatagtatatagggttttgtattttgttattttttttatttgattttttataagagttttagtaatttgttttgtttagatatgtttatttttttttattttttttatttagtaagtatttggtgagtgtatattgtgggttaggtgttgcggatatagtcgagaacgtaatagataataatttttgttttagaggagtttatattttagtaggaaaggtagatgagaaaaaaggtaaatatgtataagagtgcgttagatggtggtaagggttatgggaaaaaaattaagtaggggagagttgttatttttatatggagagttaggggagagtagtcgttaaggaggggataattgggtagagattaaaaggaggtgaaggaattgagttcgtgagtatttgagagtagtaagttaggtggaagcggtagtcggtgtgaagggtttaaggttggagagtgtttggtaggtgatatggggagaggaggttgatatgggttcgggggagaggagggaggtagcgggagaggagaatagagtgacgggggttagattgagttaggttttttcgggtgttgttaggatgttgagtgagataggagttataagagggttgtgaatagagggatgataggttgtgattgagattttaataggatttttttggcggttgtgagaagaatagattgttggggttgaagaagttattgcggtagatgatggtggtagtagtggggttggcgagaagtagttggggtttggagaaagtttgaatatagaataggatttgttgatagatagtatgttcgggggaggtgagagaagggtttagggtgagtttaggtttgtggtttaattatttataaagatagtattgtggttagttgaggtgggagttttgtaggagagtaagttttgaggggggttatattagttttggagatggttagttttagaggtttgttagatatttacgggtatgttatgaatatattttaataatttaaaaatgtaagttaggtatacgatttttatcgtgggttgtatattttttgaattatttaatttattgaatttttaaattatcgttaaagggtggggattattattttttttattttttatatgaggtaatggaggtatagagaagtaatttgttttaagttatatagttggaagttggtagagtcggaatttaaaatttaagtggtttggttttagtgagtaatcgttttatattattagttttttatgaagagaaatagagaagggtaagattttagagagtgataggaatgttgtttttatatagggtgtataaggagtttttttttaaggaagtgatatttggtttgaaggaggggaggtagtaagttaggttgttttttgtgggggagggtttttaggcggagcgaacggcgtgtataaaggttttgaggtagttattttgaattatttatcgttttcgagatagttttaatttttgagggtaagtacgggttgtttttttcgtagggagagttttttttttattttatggatttaattatataattatcgtattttaggaagaatttattttttttttgcgtgattaaaggtgttaaataatttgtttgtttttgtaaatttgtttttttttttgagtttttagttttatgtttttttgtttttgttttggttattttggtttaaggttattttgagtaagttatttagtttttttttgtttgtttttttatttgtaaaatggggatattttatttttaaagttaaatatttttaaaagtatatttattttttaaggtttttgtgaggattaattgtgttaattttgtaaaatatttttgtaaaagatttgaggggttgatttttttttttgtttttataagtagtattgttaggaattttttttttatatatgtgtttttgtatagtatattttaagtattatagtgtttaataatgaatatttattgaaataatattatttaggtgttagaaaattaaattatttttagaaatattttttatgtttgtgtttttaggagagtgtattatgtatattatagtggttattttttgggttttttttcggagacggggattttattatgttgtataggttggtttggaatttttgggtttaagtgatttttttattttagtttttgtgtttagttatatattatagttttgtgaatatatttttttaatgtaataatatagtttttatttatatatataattagtatttttagaaatagtttttatatttgtgtttttatagagtatattatatattttagttttgtgaatatatttttttgaaaaggaggaaaatttttatttatatataaattggtatttttagaaatatttttgatatatgtatttttttgtagtgtattttaggtattatcgtgtggtaaatattttttgggggttggtatttgaatagaaaagtgtttttgatgtgtggtagatattttatagatattagttattagttagtgtgttatttttttttttttgtttttgtaattttattttatgtattatttgtattatttggtttttattatttgtgtgattttattttttattttttttcgtattttgttttagttatattggtcgttttgatgttttttgaatatggtaggtattattttattttagggtttttgaattggtatttttttttgtttggtatgtttttttcgtagatattaaggtttttttcgtttttatcgtgaggttttaatttaagagttattttttttatgtttaagattttaattatttttaatattcgatttttatttgttttattttattatttttttttagtatttgtttattatgttaattttatttatttattttgtttatatagtttgtttttttagtttgggtttttttttttttttttttgagatagagtttcgttttgttatttatgttggagtgtatggtgtaattttggtttattgtaattttcgttttttgggtttaagtaatttttttgttttagttttttaagtaattgggattataggcgtacgtcgttatatttagttaatttttttgtattttagtagagatggggttttatcgtgatgtttaggttggttttgaatttttgagtttaggtaatttatttattttagttttttaaagtgttaggattattggtgttagttatcgtgtttagtttttttaatttttaataaatgttagttttataagtataaatatttcgttttgtttcgttttttgttatattttagtatttagaagagtgtttggtatttataaggggtttagtaaaggttggttgtaggaatagttttaattaattagtttttatattttttttttttttttatgtgatttttatattggtgttttaaattattttttttttatttatttatgggataaatttttattgagtatttgttgtttatttggtatatttttagttgttggagatatagcggtgaatgagtagataaaaattgagtttttatgggatttatattttaatgaggagagatagataataaataagtaatttatatagtgtgttagatagtgataaagggtaacgggataaattagggatttggtttgagttttgttgggtgtgtagttttagatggttagggaggggttgattttttttgtttttataagtagtattgttaggaattttttttttatatatgtgtttttgtatagtatattttaagtattatggtgtgataattaatttttaatgaaataatattatttaggtataataaaattaaattatttttagaaatattttttacgtttgtgtttttaagagagtgtattatatatattatagtggttgttttttgggttttttttttttagaaaaagggatttcgttatattgtttaggttggtttggaatttttgggtttaagttatttttttattttagtttttcgagtagttgggattataagtgtatatttttgtgtttagttatatattatagttttgtgaatatatttttttaatgtaataatatagtttttatttatatatataattagtatttttagaaatagtttttatatttatgtttttatagagtatattacgtattttagttttgtgaatatatttttttgaaaaggaggaaaatttttatttatatataaattggtatttttagaaatattttttatatatgtatttttttatattgtattttatatattatagtgtggtaaatattttttgggggttggtatttgaatagagtgttgaaaggaattatgtagagatttgggggtggtgtttaaggtataaagaatagttaatgtaaaggttttgaggttggtttatgtttgttatgtttgaggagttgtgtggtggaattagtgtggttggagtatagtaagggggtgggaaggtataggcggtaatgttagaaaggttatttgttttattattaatttatagttaatatttatttatattggaagggattttagttttgattttttattttataaatgaagaaaaaggtatagagaggaagtggttaaattatttatttaaggttatatagttgttgggattggggggtgggtgggtgttgagagaaggtgaggaatgaagattgttttgtaggtagagggaatagtaagaataaaagtttggaggtgagaattaatttggtttttaaggattgaggttttacgtggggtgggatgagatttaagaggggagttttaaaaattattttgtgttttgagtattttttgggttatttttgagtaaggaatttaatttttttatggtttaatttttttattatttattttatggggttgtggtgaggattaaaggaatttatttatatgaaatattttgtttgatatacggtaggtgtttaataaacgttagtttttattggtattattattattattggcgttaatgtatttatttattgtagtgaggtagaacgtttttgtggttacgagtgtgattaggttgatttattattaagaggtggaggatagggaaggtcgtatagtgttttattataaggaaaagaggattagtacgtttttttttgggaagggaaaaaaaaagagaaggaaattgaaagtatacggtcgatttttttttaattataaagtattggatttacgggagggtatgcgggggattgtgtaagtatataggggtgtgggggaggaaggttaatgaatagatttattgtaaagggaggggtgatgaggtttatcgtttgaggggaaggggagtagaaaattttatagatttttgtattatagtgagaggagagaaaagttattatatagattgatttaaagtagagagggaaaaggttatggattgagttattgaaaatagggagatgtaaagtattaaattaatttattattaaaaaggagagaattttaagcgttagagcgatagtttacgaaaaagaggagatagggtaatggattgatagttaaagggacgtgaatttaaatatgaagattgatttattataaaatggtggtggtggtggtggggggggggggtggttttgaaaaaagttatggattgatgtattgggggattggaggaggtaggaatataaatttaggtagatttattgttaaagagggatgcggaggagtgcggcgttacggattgattcgttacgatgtataggaagggtggaataaataaggttacggacgggttttttgaaagttgaggttaggagaaatttaaatatttagatatatttattattaagggggttgaatattgttataggttagttttttataagtgggggtgggtggggggcgggtgggggtaggggtagggggaaagtttatggacgagtttattttaagttggcgtggggaaaaatataagtacgtagatcgatttattatataacgggagggggaggttaggttacggttagatttattataagggacgaagggtttgagtaatgttatacgtaggtttattagtcgtggtggtggcggcggggagtcgaatattagtaggttatcggttaagttatattttttgcgcgggggcgggaaggatacgtggggttacggattgggttttttattttttaggtttagagtttatttgtgtgtagcgtggcggtggcgttggtaatgttggtagtttcggggggcgggggttttatacgcggttttatcgttttttaggtttgggtttcgaggcggcggtggaggtggtggtggcggtggcggcggtagtatttagaagtcgtttttgcgtttttttatagtttacgtgggttcgaggaggaggagtttaatgtttcgtcgttcgttgattggttaaagcgttattaatcggtcgtaaggtttcgaggggttgggggacgggtttttttttatagagttgtgtcgtgattggcgtaaggggaaatgatggaacgtttacggtttttggagtttcgaggaggcgcgttcggtttttacggtgttttacgtcgattggtttaaggattgacggattgtgagtaattgaaaaggttcggggtttgtgtcgggggggcgggggtttgttttatattgattggtttatatgggattgatggaagatagtttttaaggacgggggtgggtggttttgtttttttttgattggcggacgagggatttttagatttttgttaaaatattaagggggcggtgtcgtacgttatgttgtttagcggaagtagggtttgtatagaaatgggcgtagtagtcggcgggagtgggtcggattgggtttcgcgtaggcgggtagggtagttttacggttagataagattatagagttgggtaaagacgaatttagaatatagcggaggtaggagggtaggatggttgttaggtatacgaaagagtattgagtggtagaaacgaaatgtttttagagggtagggttgaattgcggttagagttaaaaaggggaggaatttggttttgtattgattggcggtggttggatttaatttagaataggggttcgattagggagagcgggatttaggtttgtgtttattggaagttggaatatttataagtaggggttaagataaggtagggttgagttagggtttgggtgtaatttggggtatttggggaatgattgggtgtgtgaaagcgtaaattttagggttttttgattgttgtgggaatgaataaatttttattatgaattggtttattttttatggtaatttaaagggtggcgtttaggaaaaggaatggaagaaagggtgaggtggggggtttaggttgttaagatgatagaagagagggtagtgtataaggttaattggtaaatattgttaggtaataggttggaggtaggattgttggggtattttggaggttttatagagagattggatttttgggttttttagtaattttgtgttttaggaataggttttcgtggtaattagtagggtttatggggaaaaagaagggttatgtgatttaaaggtatttaggttttttaatgtttgaggatggggggaagaagttaatggtgaggtttttttgggaaattttgtaggttttgtagttttttaagtttttgaaaaagaggatagaagagattgaataaagattgggtttgggttacgtttttaggtttgttttgattttttttttttgattttagtttagagggaaagatggttttttttttttttcgtttttttttttttttaggttattattttaaatatagagtttggtagtggggtgagttgtttttatttttagtaatatgtggatatgggttttgatatttatggagtttttggtgaggttgttgttgagtttagagaaaagaaataagaaagggtaaaatgggttttatatgattatgatgatttttttttattattttaagatttatttatattttggatgatttttatttggtttatttttatgtggaaatgttaagttattatttggtttttattgatttaaagattattaaatgtttattgtatgttaggtaattttaggtattgggagatagtagtaaatataataaataaaattttcggtttgatggattttaaatttttgtaaagaaagatataataaaaaattaatggaataaaagttatgtgttagatggttttaattataataataaaaattaaaaatgagagataataaggagtataggagtggggggttgtaattttaaagagggtttagggatggttttacggagaagtatttgagtaaagatttaaagatagtgaattttgagtagtgtggttatatggaggatgtgttttatatataaggggtagtaaatataaaggtattgaggtgggagtgtgtttggtatgtttgaggtgtagtaaagaggttattttggttggagaagaataagtgaagggggaatgtaagaggtgaggttagagaggtaatgagggagataaattgtgtgaagtttataaggttatggtaaggattttggttttgattttaagtgagatgggagttaagggaaggttgtagtagaggaaggaggttgaattatatgaattagttagttgattttttttttttaagttagtttggattagatttcgtttaaaagaattttaattgatataaagggttaaggaaggttttttttaagaatgaagaatgagaaggaatcgaagaatgtttaatggttaagtagtaggaaggttttttttataaaaaggataagaggtaataaagagttgtttgagaagtagtgaggttagagtgttagaaattgagtggggagggaaagtggtttaagataaggtttaagagataggaagaggttagattatatagggttttaatataataaggaatgtggattttattgtgttgttaatgtaggagttagtttgaggggtaaatgaaattaaatattgttggaaaagtagagagtaataagataggatgttaaattggaaaaaaaagtagtatgaatttatgtatatattaatattttttatatttttatttttagtttagaatttttttttgaatttgattagttttaatgatattttttaaaaatttattttagtgtttaataagtgttttatatttaataggttttagattaaatttttgatttttttttttaaatttattttttttttaatttttttattttagataatggtaattttatttttttagttgtttagttaaaaatttgggttttttttttttatattttatatttagttagttattttttttaaaattatgattgttttattgtaggtaatgtttttgatttttatgatatgttttttttatagtattgttaatatttgatatattatattatttatttgtttattgtttgttttttttgattagaatgttagttgtatgagggtagattttgtttttttttgttttttgttttatttttagggattagaatagtgtgtggtatagaggaggtatttaacgtatgttgaatgaataagtgattattttattaaaaggaatttgaggttggttgagtgtatgtttagggataggaaataaatgaagtatgggtgttgttgttagagagtaagaatatttttaagaatattttgggggtaatgtttaaagaatagaagaatgaatttgattagtttttaagggataattttaatattaaaaaagagaataaaattagttaatggtgtaagtttattttatgaaaatttatgagtttaatattttaaaagggagaaaaatatagagtttattaaatgttagttgtaatataaaagggatatgtttattattgttgatttatttttatttgttatgtgagaagtaaattattattgatttagtatgtaaggtagtgtgaatagttatatggttatgtttttttttttttttttgagatggagttttattgtgtcgtttaggttggagtgtagtggcgtgatttcggtttattgtaatttttatttttcgagtttaagcgatttttttgttttagttttttaagtagttgggattataggcgtttgttatcgttttcggttaattttttgtatttttagtagagacggggttttattattttggataggttggttttgaatttttgatttcgtgatttatttatttcggttttttaaagtgttgggattataggtgtgagttatcgcgttcggtcgttaggttgttttttttataattatatgtttatttatgagatgtggatgtgtatttttttttgtgttattaggaaagaatatagagattttattttttttattttttaaataaagaaatatattaagaataggaagaattgatatttttgattatataaaatgattagaaagttagtttaaagtatattttaagtaattaaatatttttaaaggatagttagttatatagatttaaatttttattttttagaaaaattaaatttttagatagttttattaattataataaagtagtaagatttaattatattttttattatattaatagattaggttagtatattaaaaagattaggtaagggggtaggtattgataatttaaatattttattttggggaagtacgtggagttttaaaatattaaaatttatttgataggtttaggaattttgtgatataataaggaaagtttttttatataaattagattttagttgggcgcggtagtttatatttgtaattttagtatttagggaggttgaggtgggtagattatttgaggtcggagtttgagattagtttggttaatatggtaaaattttgtttttattaaaaatataaaaattagtcgggagtggtggtgggtgtttgtagttttagttatttgggaggttgaggtaggagaattttttaagtttaggaggtagaggttgtagtgagttaagatcgtattattgtattttagtttgggcgataagagtaaaatttcgttttaaaaataaagtggatttggtttaaatgattattagtttagaattgtgttgattatgaaagtaggtcgtttaattaaattatttgttaattggtttgaatattaagaattagaaattttagtaggtttgaggtttttttgggtttattagtatttgttagttttttttatggttggaaaggtttgaaaagataaaaattattgaaattttaagggaggtaattttggaaaaaatgaatgtagaatagatataaatataaaatataattaataaagaagtttaaattaatggtatttatatttgtgagatgttgttaatttaagtgtattgtttagtgttttt

SEQ ID NO: 53 - DNA, 9021 bp, Artificial Sequence
  Chemically treated genomic DNA (Homo sapiens)
tgtttagtttagggtttgtgaatgtacgaatcgatattttgtatttagttattttggtggggaggtggagaatttttgtgtttagtttagggattgtaaatatattaattagcgttttgttaaaatagattattcggttttattaattagtaggatgtgggtggggttagataaaagaataaaagtaggttgtttgagttagtagtggtaagttgtttgggtttttttttatattgtggaagttttgtttttttttgtaataaattttgttgttgtttattttttgggtttatattgtttttatgagttgtaatatttattacgaaggtttgtagttttattgttgaagttaatgagattacgaatttttcgggaggaatgaataatttgagacgcgttgttttaagagttgtaatatttatcgcgaaggtttgtagttttatttttgagttagcgagattataaatttattagaaggaagaaatttcgaatatatttgaatattagaaggaataaatttcggatacgttatttttaagaattgtaatatttatcgcgagggtttacggttttatttttgaagttagtgagattaagaatttattaatttcggatatattagttattagggaggttgaggtgaggggattatttgaatttaggaagtcgagggtgtagtgagtcgagattatgtcgttatattttagtttgagtgatagagtgagattttgtgttaaaaaaatagaataaaataaaataagaacgttgaataggttgtgtgttaattttgagatggagtttagatttaagaatgattttgaggtttagatttatatttaagaggatgattttagtttggtatttataggttttttaggtattttagatgtattttgttttgaattaagttttttgtttttgaatttgttttttttggtaaatagtattaagggggttagaaatttgggggttgtttttatttttttttttttattatgtatttttaatgggtggttggatttgtggttgtattttcgtgattttttagtttttttttagtgatggttttaggtgggtttttattttgttttttaaatggtttttttgttttgagttttattttatttgtttttagtttatttattgagttattttagagattattttgattttttgtggatatttttttggtggttttttttttttgttagttagaaattgtttttgattgtatgtaataaatgtggttacgttatttaattaaataaaggtttatttttttcgtgatgaaaagtatatagataagtagtttatttttatcgataattattgagggttttttatgatttttatagtaatgaaatgtgtatttatagtataaagatatataattttaaggttttaatataattgggtttaagtatagtattttttgttttagtttttaattgtttaggtgattttattgtgtagttagggttgataaatattgtatttaggtttagtgtttttgatttgtagttgaggtttagagagaattattgaaattgtagttttagttatttgggaggttgaggttggagaattgtttaagtttagcggggtgaggttgtagtgagttaagattgtattatcgtattttagttcgggcgatagagtaatattttatttaaaaaaaaaaaaatttttggtttatttttttgtttattttttaattatagaggtttttaaatatgaatttttatttttaggaaggttgaaatgatatattataagcggtttagttatttgtacgtgtcgttatttgatttaaggtatttatttttttttattatttttgataaagttgaattgtttatatgtgttatatttttttttttttttaattttttttttttttttttttttttttttttttttttttttttttttttttttttttttttttttttttttttttttttttttttttttttttttttttttttttattttttttttttttttttgatagggtttgtttgttttgtttttttaaattttggggtttaagtgtaaaggttttttttatttgatttttttattttattttatttaagttagatattttacgatgatgatgatgattattgttgagataggattttattttgttgtttaggttggagtgtaatggtgcgattataatttattgtagttttaattttttgggtttacgcgatttttttattttagttttttaagtagtttggattataggggtgtattattatgttcggttaattatatgtgttagatttaatttacgttttagggttttaaataattaaggttttattattttgttttaataaatatatttttataaagatttggaaggtaggttgaaatgtggaatttttggattttttttagttttacgtagaagggtagtagtggagagttggttgtttgttcgtttttggtttttttttttttttttatttttgttttttgtggtattgggtagggtttacgtttaaggttagtagtgtatttaataagggatagtttttgtgtggtttgtttaggattttatatataggtttagggttttttgggtaggaaattttaggattcgggtatttaagtggtgttttaaatagtggtttttggtcgggtgtggtggtttatatttgtaattttagtattttgggaggtcgaggttggtagattatttgaggttaggagttcgagattagtttggttaatatggtgaaattttatttttattaaaaatataaaaatttagttaggtatggtgtgtacgtttgtagttttagttattcgggaggttgaggtaggagaattatttgaatttagtaggcggaggttgtagtgagttgagattgtattattgtattttagtttggtgatagagtgagattttatattaaaataaatatataaataaataaaaatagtgatttttaattgggagtgatttggtaacgtttggaattatttttggttattttagtttggtagggagggatagggtattattggtatttagtgagtaggggttagggattttattgaatattttatagtgtataggatagtttttatagtaaagaattgtttggtttaaaatgtttatagtgtttatattcgatgttttgtattaggaagatataaatatttttaaatattatagagttaaattttttatttttgttttagtagagatgatatttttgcggggggagtatttttttggttttaatatatttttttttttatgggagatgatgttagaagagggatagaataggacgattattttacgaaggtattatttaggtattattagatcgttttaaaagaagagtaatttattgttttaaagtagttttttcgtgtttgtgggcggattttttggtaagtttataatgaattgaaatttgtcgaattttttggaatttaaagaaattttagttttgggtaaaggttttttggttagtatttgtattgtttatgtaatcgtttagaatatacgaattatttggagattattattaaatataataggtaaaattgtaaatatgtatattttttagaggatgataaaaaaatgtgaattgtatttttttgatagaggatgtattagagtttgagggtttaaatagcgtaaataataaataagtaaataaatcgatagtagtgtattttaaacgaggttggaatagtttttattgttgttttatattggattttaattaagttttagtattttgttatatttaatattaagtattaggttggacgtggtggtttatgtttgtaattttagtattttgggaggtcgaggtgggtagatggttggtttgagtttaggagtttgaaattagtttgggtaatatggtaaaattttatttgtatttaaaatataaaaattagttaggtgtggtggtatatgtttgtggttttaggtatttgggaggttgaggtaggaggatggtttgaatttaggaggtggaggttgtagtgagttatgatggcgttattgtattttagtttgggtgatagagcgagattttgttttaaaaattaaataaataattttttcgtttcggataaaagtagtttgtattatttttttattttataatatgtttttgaaatattttttttgaaaggtaagttatatttattatttttgttgtatggaggtattataaattattttattattttattttttttgagtgttgtggtttttaggttagataaaaacgtaggtgatgtttagaagttaattagttgtcgtttggttatttgtagggttgtggttttgttaaataggaaaaatataaaaagaatatcgaattttgttaattaaataagaaattttatattaaggattaagaaaattgtaggggaagaaaaggtaagtttcgggattgaggtgtagcgattttttatatttttagaaaattaaaaaataagataaaaaaatgaaaattataaaagtatttattttggggcgttttaattgttgagtaataaatgagacgttgtggttaaatttagttataattaatgatatttttagataaagtgattttagatttttaaagcgtattttgtttatattattttgttaatttcgcgtattgtaatcggcgggttacgttttcgtgaaaagaaggttgttttttttatatttcggggttttggacgtttttcggttgcggggcggggggagttttcggcgtacgcggttttttggtttcgtttttagttattttcggttattcgcgattcgaggttgtcgtagggggcgggttgagcgcgtgcgaggcgattggtttggggttagagtgggcgaggcgcggaggtttggtttataaagtagtcgcggagacggggtgttggtttgcgtcgtagttttttgtagcgtttggggttttcgttgtagttttcggaattaggatttcggcgtggtttagcgagttatggcgacgaaggtcgtgtgcgtgttgaagggcgacggtttagtgtagggtattattaatttcgagtagaaggtaagggttgggacggaggtttgtttgcgaggtcgtttttattcgttcgttttttcgcgtatttttgttaggagcgggtcgttcgttaggtttcggggtcgttttggtttagcgttcggtttcggttcgtgtcgttcggtcggtgttttcgtttttagcggtgcggtgtttaagtgttgagttatcgggcgggttcgggcgcggggcgtgggatcgaggtcgtcgcggggttgggtttgcgcgtggcgggagcgcggggagggattgtcgcgggtcggggaggggcgggggcgggcgtgttgttttttgtggtttttgggtcgtcgtcgcgggtttgtcgtggtgtttggagcggttgtgttcgttttttgtttggtcgtgttttcgtttttgagggtttcgcggatatcgagtggcgtagtgttaggtttagttcggggatggcgattgcgtttgggttcgtttggtgttttcgtattttttttcgtttttcggttttagcgttttaggttagggagttttcgtttttgtatagttttaaggttaggaatggtttttatatttttaaaaggttttggaaaataaaaatacgtaatagagatcgtttgtgtgatattttgtagggaagtttgttggtttttgttttaggttatgattgggttgtaagggtagagaaggtagttttgaatagaggttttttttttttttttaagtttcgggagttagaggtttaattgatttttttggggatttttgagggtagtgattttaattttgggtgtatagttagtttatttgaagattttattaaaaatatattagagtttaattttcgattaattatattaaaatttgttttagtgtagggtgagtattgttgttttttgaaagtttttaaaagtgattttgatgtgtatttacgattgagaattgtcgtttgaggatagtgggtggagtttcgtatttggaaattagaagatttggagtttttattatatcgaattggtatttaataattgttgtcggagtattttttaagttatattttcgtaaagtggttttaaaattgttttgttagtaggtaggttgttaagatggttagagataaatttttgaacgatttttgtaaaatatatagaaatatttttagaatttttattagtaaaattataaaacgtgttgtaaggaaggtgtttgtgataatattgtttttagaattttagtgaagttattaattggtggaaaatttttttttgtattcggtttaaaaattatgagggaatatttattatacgaatgagatttagtttttaaaggggtttatagaaacgtgagaggataggaatagttagtttgtgtaaatgtttgaaatatatgtgagggagataatgagtttagtttttttttttaataggtttttagattttttggaaaaggttttttggtatttgattttattttgttgttttatttgttagatttttttttgtttttttttatttttttttatataatttattagtattagtgttttgttttttagattaagtttcgttttgtcgtttaggttggagtgtagtggcgcgattttagtttattgtaattttcgttttttaggtttaagtaatttttttgttttagtttttcgggtagttgggattataggcgcgcgtcgttacgtttggttaattttttatattttagtagagacggcgttttattatgttggttaggatggtttcgatttgttgacgtcgtgatttattcgtttcggttttttaaagtgttgggattataggcgtgagttatttcgttcggttattagtgttatttttaagacgtttttgaggaattttttttttttggttattgagaatttatgtatgaatttaggttttttattttttttgagtagtttgtatagtttttttttttaagcgtttgatttcgttttgtttggtgttcgttgtatttgagaatgagttttggatagtggagtattttagttttttagatatgtagagataatatattggttattagttatttggtttggtttatttcgtgtttaaaattttggattttttgttagtttttatagattagaattttttacgtattaatttagtttttttagttttttttgaagaatttttggagatttttttatattgagtttttattagtttaggatagtattgttgtagtagtttatatattttttcgttttttaggtttgtgttatttatttaagtttatagtttggtttttgtagggttgtattcgagtatagttatttagatgttttgaatgtattatcggttaaatggaggttttaaagaatttgttgtttttggttttgtgtttttgataatagagtgtttgagggataatttttatatttgagtttttttaaaattaaaggttgtagaagagttatagtatttattgttaaaaagaaaagaatttaaaaaggtagtaattgttaggatattttatttgagtaatgatattttttagtggaaagttatattttaagggttaatgttttttaattgttggtcgtatttgaaaataaattaagttaaaaataagagatattgatatgttgtatgacggtgtggtgtggatgttgtgtttattttagttttgagatttagttgtaatttttttgatttttgtatgtagttacggagtattattatttgttattattatttgaatggttatattgtttgtttttattttggtagagtggaaaggttatttaggttttagtgtttgaaaagattttagaaagtagtagtacgtttggttagattagaattagtttttttttgggggtagtggaatataatattttttgattgttaattaaaaatatttgtgatagtcgggcgtggtggtttacgtttgtaattttagtattttgggaggtcgagacgggtggattacgaggttagtagatggagattattttggttaatacggtgaaatttcgtttttattaaaaatgtaaaaaaattagtcgggtgtggtggtgggcgtttgtagttttagttatttaggaggttgaggtaggagaatggtatgaatttgggaggcggagtttgtagtgagtcgagattatgttattgtattttagtttgggcgatagagcgagattcgttttaaaaaaaaaaagaaaaaaatttatgatggatatttaaaaatatttattgagtggggagtggagagtaggggttttagggtagtttgttggatatttttagggcgattttttttttttttttttttaaagttaagtgagtatgttatatggaaaagggtgtgcgtggagaaaaagtaaggggttttagagtgtaggatgagatatatattttttgggttaaaaaggttgaggtaggagaatggcgtgaattcgggaggcggagtttgtagtgagttgagattatgttattgtattttagtttgggcgatagagcgagatttttgttttaaaataaaaaacgtttatatgtatatgtatatttaatatgtataaatataatttatttaaaagtatttattatataaataggtatttatattatttatttattgtaatagttaaagtttatgaagtatttaatattgatgtgtaggtatttattttgtttgttattttattaggtgttttttatgttatttaattatgaagtttggttatagggtgtttgtgtattgagtgtgggaataagattattattttttttttgaggatataggtttagagtagttaagtagtttgttggaggtttattggttagaaagtggttagtttgggatttggatatagatttttttatttttaagtttggttgttttttattttattgtgaggggtaaaggtaaattagttgttttttttgtttagaaattttttttaattttgtattttttttaaagg

SEQ ID NO: 54 - DNA, 9021 bp, Artificial Sequence
  Chemically treated genomic DNA (Homo sapiens)
tttttaagaaaagtgtaaagttggagagagtttttgaataaagaaaatagttgatttatttttattttttatagtgaagtaaaaagtagttagatttgggagtggaaaaatttgtgtttaaattttaggttgattattttttagttagtgaatttttagtaagttgtttaattgttttaggtttgtgtttttaaaagggagatggtaattttgtttttatatttaatgtataagtattttgtggttaggttttatgattaaataatataaaaagtatttaatagagtggtaagtaaagtgagtatttatatattagtgttagatattttataggttttgattattatagtaaataggtaatgtaagtatttatttatgtagtaaatatttttgaataggttatatttgtatatgttgaatatatatgtatatgtaaacgttttttattttgagataagagtttcgttttgtcgtttaggttggagtgtagtggtatgattttagtttattgtaagtttcgtttttcgggtttacgttatttttttgttttagtttttttaatttaaaaggtgtatgttttattttatattttggagttttttgttttttttttacgtatatttttttttatatggtatatttatttgattttaaaaaaaaaaaaagaaaaagtcgttttggaaatgtttaataggttattttgggatttttgttttttattttttatttagtgagtgtttttaagtgtttattataagtttttttttttttttttttgagacgagtttcgttttgtcgtttaggttggagtgtagtgatatgatttcggtttattgtaagtttcgttttttaggtttatgttatttttttgttttagttttttgagtagttgggattataggcgtttattattatattcggttaatttttttgtatttttagtagagacggggttttatcgtgttagttaggatggtttttatttgttgatttcgtgatttattcgtttcggttttttaaagtgttgggattataggcgtaagttattacgttcggttattataggtatttttaattagtagttagaaaatattatattttattgtttttaggagaggattgattttagtttaattagacgtattattgttttttgaaatttttttaagtattgaaatttaggtaatttttttattttattaaaatgaaagtaagtagtatagttatttaggtaatggtgataggtaatggtgtttcgtggttatatatagaaattaaggaagttataattagattttaggattaaaataaatataatatttatattatatcgttatataatatgttagtgttttttgtttttagtttggtttgtttttaaatacggttaatagttaaggggtattaatttttaagatgtgattttttattggaaaatattattgtttaaatgaagtattttggtaattgttgtttttttaaatttttttttttttgataatagatattgtgatttttttataatttttaattttggaaaaatttaaatgtgaaagttgttttttaaatattttgttattaagagtatagggttaaaaatagtaggttttttgaaatttttatttaatcggtaatatatttaggatatttaagtagttgtgttcgggtataattttgtagggattaggttatgaatttaagtgaataatataggtttgggaagcgaaaaaatatatgaattgttatagtagtattgttttgggttaatgaaggtttagtatgaagagatttttaaaaattttttaagagaagttaggaaaattggattaatacgtgaaaaattttgatttgtaaaaattagtaaagagtttaagattttaaatacggaataggttaagttaagtagttgatagttaatgtattatttttgtatatttggaaagttggaatgttttattatttaaggtttatttttaggtataacgggtattaaataaaacgaagttaggcgtttaaaagaaggaattatgtaagttgtttagggaaggtggaaaatttgggtttatgtatggatttttaatggttagggagaagggattttttagaggcgttttaagaatagtattggtggtcgggcggggtggtttacgtttgtaattttagtattttgggaggtcgaggcgggtggattacgacgttaatagatcgagattattttggttaatatggtgaaacgtcgtttttattaaaatataaaaaattagttaggcgtggcggcgcgcgtttgtagttttagttattcgggaggttgaggtaggagaattgtttgaatttgggaggcggaggttgtagtgagttgagatcgcgttattgtattttagtttgggcgatagagcgagatttggtttgaaaaataaaatattagtattggtgaattatgtggggagaagtaaagagggataaaaagaagtttgataaatgaaatagtaaaatggagttaaatgttaaagaattttttttagaaaatttggagatttattaaagaaaaaggttaaatttattattttttttatatatattttagatatttatatagattaattgtttttgtttttttacgtttttgtaaatttttttaaagattgaattttattcgtatagtaaatatttttttatgatttttaagtcgagtgtaagagaaaattttttattagttggtaattttattaaggttttggggatagtgttattataagtattttttttgtaatacgttttgtaattttattgataaaagttttgaaaatatttttgtatattttataagagtcgtttagaagtttgtttttgattattttagtaatttgtttattggtagagtaattttaaagttattttacgaaaatgtggtttaagaaatgtttcgataatagttattaagtgttaattcggtgtaatggaaattttaggttttttaatttttaaatacgaaattttatttattgtttttaaacgatagtttttaatcgtaggtgtatattaaaattatttttggaaatttttaaaaaatagtaatatttattttgtattaggataggttttgatgtaattggtcggaggttgggttttggtgtatttttagtaagatttttaaataagttaattgtgtatttaaagttaagattattgtttttaaaaatttttaaaagggttagttaaatttttggttttcggagtttaggaggaggaaaaggatttttgtttaaggttattttttttgtttttgtagtttaattatgatttagaatagaggttagtaaatttttttgtaaagtgttatataaacggtttttgttgcgtatttttgttttttaaagttttttaaaaatataaaaattatttttagttttagagttgtataaaagcgaagattttttgatttagagcgttgaagtcggaaagcggagagggatgcgaagatattaggcgggtttaggcgtagtcgttattttcgggttgggtttggtattgcgttattcggtgttcgcgggatttttaggaacgagaatacggttaagtaagggacgagtatagtcgttttaggtattacgatagattcgcggcggcggtttaaggattatagagggtagtacgttcgttttcgttttttttcggttcgcggtaattttttttcgcgttttcgttacgcgtaggtttagtttcgcggcggtttcggttttacgtttcgcgttcgggttcgttcggtgatttagtatttgggtatcgtatcgttgggggcgaaggtatcgatcgggcggtacgggtcgggatcgggcgttggattagggcggtttcgaggtttggcgggcgattcgtttttagtaaaggtgcgcggggggacgagcgggtgggagcggtttcgtaaataagttttcgttttagtttttgttttttgttcgaaattgatgatgttttgtattgggtcgtcgttttttagtacgtatacggttttcgtcgttataattcgttaggttacgtcgaggttttggtttcgaggattgtaacggaaattttagacgttgtaggagattacgacgtaaattagtatttcgttttcgcgattattttataggttagattttcgcgtttcgtttattttggttttaaattaatcgtttcgtacgcgtttagttcgttttttgcggtagtttcgggtcgcgagtggtcgggaatgattgggggcggggttaaggggtcgcgtgcgtcggagatttttttcgtttcgtagtcgggaaacgtttagaatttcgaaatgtggagaaaataattttttttttacgggggcgtggttcgtcggttgtagtacgcgaaattggtaaaatgatgtaaatagggtacgttttgaaaatttgaagttattttgtttagaaatgttattagttatgattgagtttggttatagcgttttatttgttatttagtaattgggacgttttaagatggatgtttttgtagtttttatttttttgttttgttttttagttttttgagggtatagaaagtcgttatattttaatttcgggatttattttttttttttttgtaatttttttagtttttagtatagagttttttatttggttggtagaattcggtattttttttatattttttttgtttggtaaggttataattttatagataattaaacggtaattagttggtttttaggtattatttgcgtttttgtttggtttaaaggttataatatttaaggagggtagaatggtgaaataatttatgatgtttttatataataggaatgataaatatgatttattttttaagggaaatattttaaaaatatattgtgaaatgagaaaatagtgtaaattatttttgttcggggcgagggggttgtttgtttgatttttgagatagggtttcgttttgttatttaggttggagtgtagtggcgttattatagtttattgtagtttttattttttgggtttaagttatttttttgttttagttttttaagtatttgggattataggtatgtgttattatatttggttgatttttgtattttgggtatagatggggttttattatgttgtttaggttggttttaaatttttgagtttaagttagttatttatttatttcggttttttaaagtgttgggattatagatatgagttattacgtttagtttagtatttaatattgagtatggtaaaatattgagatttaattgaagtttagtgtgaaataataatagaagttattttagtttcgtttggagtatattattatcgatttatttatttatttattatttacgttatttagatttttagattttaatgtattttttattagagaaatataatttatatttttttattattttttaggaagtatatatatttgtagttttgtttgttgtatttggtagtagtttttagataattcgtatattttaaacggttgtataaatagtgtaaatgttggttaaagggtttttgtttaaggttaaagtttttttgggttttaggaagttcggtagattttagtttattgtaaatttgttaagggattcgtttatagatacgagagagttgttttgggatagtgaattattttttttttgagacggtttaatgatgtttgggtggtgttttcgtaggatggtcgttttgttttgttttttttttggtattattttttatggagaaaagaatgtgttgaagttaagaagatgtttttttcgtaagaatattatttttgttagaataggggtaaggaatttaattttgtgatatttaagagtatttatatttttttaatgtagggtatcgaatgtgggtattatggatattttgggttagatagttttttgttgtggaggttgttttgtatattgtaggatgtttagtagaatttttagtttttatttattagatgttagtaatattttgtttttttttgttaggttgggataattaaaaataattttagacgttgttaaattatttttagttaagaattattgtttttatttatttatgtatttattttgatatggagttttattttgttattaggttggagtgtagtggtgtaattttagtttattgtaattttcgtttgttgggtttaagtgatttttttgttttagtttttcgagtagttgggattataggcgtgtatattatgtttggttaagtttttgtatttttagtagagatggggttttattatgttggttaggttggtttcgaatttttgattttaagtgatttgttagtttcggttttttaaagtgttgggattataggtgtgagttattatattcggttaagaattattgtttagaatattatttgagtattcggattttggaattttttgtttaaagagttttgagtttgtgtataggattttgaataggttatatagggattgttttttgttgagtatattgttagttttgaacgtaggttttgtttagtgttataaggagtaggggtggggaaaggaggaaaggttaggggcgggtaggtagttagttttttattgttatttttttacgtagaattgaaagaagtttaagaattttatattttaatttgttttttaggtttttatgaaggtatatttgttaagataggatgatagagttttggttgtttggaattttggaacgtgggttgaatttggtatatgtaattagtcgggtatggtggtatatttttgtagtttaagttatttgggaggttgaggtaggaggatcgcgtgggtttaggaggttgaggttgtagtgagttgtgatcgtattattgtattttagtttgggtaatagaatgaaattttgttttaataataattattattattatcgtggagtatttaatttaaataaaataaaatagggaaattagatgagagggatttttgtatttgaattttagggtttaaagaagtagaataggtaaattttgttagaaagaagaaaagagagtgagagagaaagagaaagaaagagaaagagagaaagaaaaagaaagagaaagaagaaggaaggagggagggagggaagaaagggaggagggaaggagggaaggaattagagaaagaggagaatgtggtatatgtagatagtttaattttgttaggaatggtgaggaggaatagatgttttaaattagatggcggtacgtgtagatgattaaatcgtttgtaatgtgttattttagtttttttgagagtgaaaatttatgtttggggatttttgtggttaaaaggtgggtaaaaaggtagattagaaatttttttttttttagatggagtgttgttttgtcgttcgggttggagtgcggtggtgtagttttgatttattatagttttatttcgttgggtttaggtaattttttaattttagttttttaagtagttgggattgtagttttaataattttttttagattttagttgtaaattaaaggtattgggtttagatgtagtgtttattaattttggttgtataatagaattatttgggtagttgaaaattaaaataaaaaatattgtgtttaggtttaattatattaaaattttaaaattgtatatttttatattgtaaatatatattttattgttgtaagagttataagaaatttttaatggttatcgatggaagtaggttgtttatttgtgtattttttattacgagaaaaataaatttttatttggttaaatagcgtaattatatttgttatatgtagttaaaagtaatttttaattgatagagaggagaagttattagaggggtgtttatagggagttagaatggtttttggaatagtttagtgggtggattgagagtagatggggtgagatttaaggtagagaggttatttgggagataggataagagtttatttaaggttattattggaagaaagttgggagattacggaaatgtaattataagtttagttatttattagaggtgtatggtgagagagggaaggtaagggtagtttttaggtttttagtttttttggtgttgtttattaaggaaagtaggtttaaggataaagggtttaatttaggatagggtgtatttgaagtgtttgaagaatttataagtgttaggttggaattatttttttggatatgggtttaagttttaggattatttttaagtttggattttattttagaattaatatatagtttatttaacgtttttgttttattttgttttgtttttttgatataagattttattttgttatttaggttggagtgtaacggtatgatttcggtttattgtattttcgattttttggatttaggtgatttttttattttagtttttttagtagttggtgtgttcggaattggtgggtttttggttttattgattttaagaatgaagtcgtggattttcgcggtgagtgttatagtttttaaaggtggcgtgttcggagtttgttttttttgatgtttagatgtgttcggagttttttttttttggtgggtttgtggtttcgttggtttaggagtgaagttgtagattttcgcggtgagtgttatagtttttaaggtagcgcgttttaagttgtttatttttttcggggggttcgtggttttattggttttagtagtgaagttgtagattttcgtggtgagtgttatagtttataaaggtagtgtggatttaaagagtgagtagtagtaagatttattgtaaagaaagataaagtttttatagtatggaaggggatttaagtagtttgttattgttggtttaggtagtttgtttttatttttttatttggttttatttatattttgttgattggtagagtcgagtggtttgttttgatagggcgttgattggtgtgtttataatttttgagttagatataaaggttttttatttttttattagagtagttagatatagagtgtcgattcgtgtatttataaattttgagttagata

SEQ ID NO: 55 - DNA, 8111 bp, Artificial Sequence
  Chemically treated genomic DNA (Homo sapiens)
aaatgggtatgttttggggttagatttggaggaatagtagagattggagtgttagaaggtgagtatgtttgggggtgttggggagatgtaatttattagggatagtttagtgttaggggattagattggggtttatgaaggagaggtagaggttgatgggtttaggggtggtgtgggtaggtgagtttttttagatagtgattttgttttgttttttttttagttaggtttttttttttatttttttttttttttttgattggatttttttgggagagttattttttttggttttttttgttttaatttttttattagttggttattattatttattattattttaagttaaatttttagatttatatggggttaggatattggtattggattaaagaggtttttttttttgttttttttttgtttttttaatgttttgttgtaaagatttaggcggggagagagagagagagagagagatagagattgatttatagttagggttagggaattgaggggaattaatttaatttttttttttttaatttattaggtttgtattttgttttttttgtagattagtgttttgttagttatttgggggttaggggatggagtgaaggataagatttttttttattgtagtgaagttatttggagaaatgtgtggaaaatagtaagatttagtgattttttttttattttttttttaattttaggagagattttgtttttttatttatcggtttttagattaattatttatatttatataggcgagagtttttttgaatattggaggtgataggatattaggataaagtataattattgtgttttggtttaattattattttttttgtttggggtcgtcgttggtttttggttgtttttcgtatttttttttatttttattttttttttttttttttttttatttggaatatttttttttttttttttggttttttttgaattgtttttagagttatagattgtggggagtggttattgcgtttttaaggtgaggttttttaagcggggtcgagtttgttttttaattgggagttagtatgatttttgtgtgggttgttttttgttttattgtttttttttttaatttgttaggtgattttgggtttttttgtgttttttttgggttttcggaggattttttggggagatagtttgttttgacgtttttttttttgtagtaagtagtttggggagggaggtgaggataagtgaagttaagttgtttagggggttaagtttatggaagggaagatgttatagagatatatgtggttttgtgattgttgttttgtgttttttttttttttttgaaagtttaggtgattaggtgatttgagtttttaatttggtgataatgtgggtattggttgagtttttaagagtatattgttgtaaatgtcggtgataatatattggggtatgggatttagagttaatttttttaggttatagttaggttatatttttataatgaaggggggaggtgggttatattttttcgttttaatgaaggtagtttaaaaatttttaggttaggttgtaattttagttttatataaaaggaattttgtgtttttatttttttggatttttgggtaaagttttagagggaaatataaataggttgttgtaatatattttgttgggtattattatggaggatagttggtttatgggggtggggggtgtttggggttacggagtgattggtgatggttatttttttttggaatttttttagtttttttttagttttagatttgtttatttgttttttattaagatttgtttttttaggtttgttggtttttttaggggttgaagaaggtcgagttgagaagggatgtaagggagggggttagaatgagtttttagggtttagagtttttattttgttttaagatgtttatagtttgtgtttttggggtgttagaggcgtataaggaggaaagttagtggttttttttttatatttcgtttattagtttagagtatggagtttaggtgaggaggtttgtttgggagggggttttgagttaggaaataaatatttattaattgtataaagattttgtttttgttgttggggagtttgttaagtggtggagataggattagtgtacgaatgatggaaagggagggttggggtgggtgggagttagtttttttttttataagggttttaggatattatatcgatggaattgggggtattggggaggtaatttagtatttttattaaattatagtaatatgtgttgaggatggggttgattaggtaagttttttggagcgttttggttaaattgagggaaattgttgtatttttatttttagtttatgtttttatagaggttatgttagttgtaggttagattttggtaagatttgggtggataattagattgattggttttattttttttataggttttagagttttaattttgttttttggggtagtttggaaatagttaggttagaaattagttaggaatttttttaagttgttttttatatgtaagaatgggatgggggtttttgggagtatttagggaagatgtggagagttggaggaaaagggggtttggaggtaagggaggggattgggggaaggataggggagaagttgtgagtttggagaagtagttaagggattttgagggaatgggggagttgagacgaaatttttatttttatttagaagatgagttatgagtttgggtttgggttgatagaagttttggtttttggtttggtgggagttttgggtagttggtttatagacgttttttagtgttggcgggtaggtttgaattattacgtaggttttggtttttattcgtttttattagttttttggttttagttttttggtaatatttggggttgggggggtagtaggaataagggtttttgtttgtttagttgtttttttttttgggttttgttagattttatagtgtatacgtgggttttaataggttttttttttttttagttattgattaatttcggaattatatagtttttcgtttttagttttataaatttggtgttaaattttttttttttgggaagtatttttggatattttttaaaggattttagttattttagtttgttggttgtcgtttattttgatgtttgtaggttagatgagggttttagatggtatattgttagagggatatattgtggtttttgtgtttagttttgggttttttgtatatgaagtaattttagttttaaatatgtagttgtttgggaggttagaaatagggggtttaggagtaaattttttttattttttttttaaagtttattttttttttagttagagtcggggtgtgtagacggtagttattagggggcgttcggttattatagggaagttgggtgaatggagcgagtagcgttttcgagagtgaggacgtgtgtgtttgtgtgggtgagtgagtgtgtgcgtgtggggttgagggcgttggagcggggagaaggttaggggttattttaggattttaatagatttgtgtgtttttttttttattcgtttttgttcggtttttcgtttttttttgttttttttaatatttttagtaaagagggaacggtttttaggttttgttcgtacgtaattttatttttttgtttttttttcgttaatgtttcgcgggcgcgtgtttttggatagagttttcgggggcggatgggtaatttttaggttgtgaattttggtgggggtcgagttttttttttattgcggcgggttgcgggttaggttttattgagcgttcgtagagttcgggttcgagtcgcgtgtggaagggttgaggttcgtttgttttcgtttttcggggcgggtcgggggcggggtttcggcggggcggagttatgcgttttttttttttttttttaaaagtcggttggtagcggggaggatcgcggaggtttggggtagtcgggtagttcggaggtcgtggcgttgggggttagtattagcgttttgtcgggaggcgtagcggttaggtggatcggttagcggatttatcggttagggcgttcggtgttggaatttgatatttattgattcgggttttattttttttttttttttttaaatatttttttttaaaattgtattgtttttcgttttaatttatttttgtttgttattttttatttgaatcgggtcgacggtttggggagattgttttatttttttaaattattgtggattttggaaattagtagaaagaggaaagaggtagtaagagttttagagagaagtcgaggaagagagagacggggttagagagagcgcgcgggcgtgcgagtagcgaaagcgataggggtaaagtgagtgatttgtttttgggggtgatcgtcggagcgcggcgtgagtttttttttttgggatttcgtagttgattagtcgcgttgacggatagatagatagatatcgtttttagttttagttattatttttttttcggtcggcggcggatagtggacgcggcggcgagtcgcgggtaggggtcggagttcgcgttcggaggcggggtggagggggtcggggttcgcggcgtcgtattgaaatttttcgtttaatttttgggttgttttcgtttcggaggagtcgtggttcgcgcgggggaagtcgagtcgagcggagtcgcgagaagtgttagttcgggtcgggaggagtcgtagtcggaggagggggaggaggaagaagagaaggaagaggagagggggtcgtagtggcgattcggcgttcggaagtcgggtttatggacgggtgaggcggcggtgtgcgtagatagtgttttagtcgcgcgcgttttttaggttttggttcgggtttcgggtcggggaggaagagtagttcgtcgaggcgtcgaggagagcgggtcgttttatagttcgagtcggagagggagcgcgagtcgcgtcggtttcggtcgggttttcgaaattatgaattttttgttgttttgggtgtattggagttttgttttgttgttttatttttattatgttaaggtaagcggtcgtgttttgttggcgtcgcgggtcgttgcgagcgtttttttcggttggggacgtgcgtgcgagcgcgcgcgtgggggtttcgtgttttacgcgggtttatgggtattaggcgtgcggcgtttttttttgtcgttttaggtgtagggggagggggcgcgcgcgttaggtgggagggtattcggagagaggtttatcgtttacgcgggttttgtttatttatcggagttatcgtacgtacgatttgggtcgattagtcgagggcgggagtcggaggaggaggtcgagggggttgggtttgcgttgtcgttgtcggttgaagtttgttttcggtcgttggtttcggacgaattggaagtttgagtagcgggggcgggagttagagattagtgggtagggggtgttcggattttggatcgcgggagggtagagagcgtggagggggtagggcgtaggagggagagggggtttgttgttattgttattcggtttttttagttttcgtcgcgagtttgggaaaagttttggggtggattgttgcggggattttttttttttgttgggttatttgcgtcgcgttaatttcgttcgttttcgttcgcgtttcgttcggtgttcgttttttttcgttcggtcgggtgcgcgcggcgcggagtcgattatattagttcgggtttggtcggtcgcgtgttttcggagtttcggttgttcgaatggggagtttagagtggcgagcggtattttttttttcgttagtttttcgcgggaaggtgatttttcgaggtagttttagttcggggatttagagaattatttttatttttttttattgtttttagattttatttttgtttagtgttaggaggaattttttgacgttttttttttttatttattttttttttagtttggagagaagtttttgttatttcgtttatttttatttttttttgcggagaagatttatttaatttttttttggttttagagtttagggaaaggatgattattgttagaagtcgtggcgcgggagtttattgggcgttttgttatattttatcgaaagtttcgatttggtgatagtgtgttttttttttttcgttaatagtttcgagtgagttgtgttttagttttcgtgggggtgggttaagggaggatttgaagagttattgttttattttatttttttggagaaatggtttgaaatttgttgtgatacgggtagtatgggaatagttttttttgaattttggaaaggagtttttgttagttttgtatatattttgttttggtgaaaggtagttttggagtaggtgtttttttggaattttaaatttgtttatttaatttgtttttgaaagggattttaaagggttttttttcgtttttttttgacgtttttttttagttagaatttttttggagaggaggtaagaggaaagttatggataggggtcgttgttaatatcgtaagttttttagattttggtataaaggttttggttataggtttttaagtagggaggagggggaggagtggttgtttggttatagtgtgatttttagaggtttttagagaaggatatttggtttttgtttgtttagaatcgttttttttgtgttttttggttttggaaggggtatgaaattttcgtttttttttttttttggggtttaggaggagtggagggtttcgggagaatattgttagggggaaggtagggggtgttatgggaatgggtgagggggttgaggtgtagaatttagggggtttttgtaggagtcgtagtggtaagttgtttagttggaagtttggtaattgttgtttttttttgagaggggttttttgtgattttggttgtttttgggagtagggttggggtatttgagtggggtgtatttggggtgtgtgggaaggagagggaaagaaagatggatagtgggatttttttttagtagggtttggtgtttcgtaggttagagtgtttttttgttttgcgagtgttgggcgggaggggagttggtgagagttggagatttttaggaagggttggtagaagtttttttttttgggtgttgttaggttcgtatgttttggcgtgttgatttttatagtttttggcgaggggaggaatgatttgatgcgggtggggagggttagaggaggttttaggtttaaggtggtgtagggggttttttaggggttgggtagtgttaaggtataaaagttttttttggtttttggtggtatttgaaggtgtttaggtgagaggggtttggtatttttttattttgggagggagaagaaattagggaataggtaggagtgggagataggtgaggttttggaaatttattgaggttttggagagatttgtgtagagaggaaaatgtggtttttttttagggtttttttttgggtttttattttttaagtaatttgtgggtatgttgggttatttttaaggattagaagagtttggatgggggagggtggttggtgtttttcggttttcggtattttttttcgtttttaatattagtttattttggtatttgttatgttagtaggagaaggttattatgttgtttttttcgtttttagttttttttttttgttttagtttaaatttgtttttttatttgattttaatatttattatggttttggattagggaattagggggatagtgagagtagggagagggaagtgtggggaaggtataggggatttcgatagtgaagtattttggggttttttttttgtatttcgagttttttagtttttaatatttggttagtttttaattttttcgggtttataattatagtagtttaggagtggtgggtatattttgtgttcgtggggattttcggttgtgttttgttcgatttagaagatttggagaagttagaggttgttggtgggagggaagtgaggagggaggaggggttgggtggttgggtttgtgtattttagtttttgtttatgtttatgttttgttttttttttgtttttagt

SEQ ID NO: 56 - DNA, 8111 bp, Artificial Sequence
  Chemically treated genomic DNA (Homo sapiens)
attgaggatagaaagagagtaaggtatgggtatgggtaggggttggggtgtataggtttagttatttagttttttttttttttttattttttttttattaatagtttttggtttttttaagttttttgagtcgaataggatataatcgggggtttttacgggtatagaatatgtttattatttttggattgttatggttatgaattcgaggaagttaaagattaattagatgttgggggttggggagttcgaaatgtaggaggaaaattttagaatgttttattgtcgaggttttttgtattttttttatatttttttttttttgtttttattatttttttagttttttggtttaaagttatggtaagtattaaggttaaataggaggataaatttggattggggtaggaaggaaggattaggggcgagaaaaataatatggtgatttttttttgttgatatgataaatattagggtgagttggtgttggagacggaggggggtgtcgaggatcgaagggtattaattatttttttttatttaagtttttttagtttttaggaataatttagtatgtttataggttgtttagagggtaaaaatttaggaggagattttgggggagaattatatttttttttttatataaatttttttagagttttaatagatttttaaagttttatttgttttttatttttatttgttttttggtttttttttttttttagggtgaggaggtgttaagttttttttatttgggtatttttaaatgttattagggattagggaaggtttttatgttttggtattgtttagtttttagggggttttttgtattattttaggtttgaggttttttttaattttttttattcgtattagattattttttttttcgttagaagttgtgaaggttaatacgttaagatatgcggatttgatagtatttaaaaggaaaggtttttgttagttttttttgggggtttttagtttttattaatttttttttcgtttagtattcgtagagtagaggggtattttagtttacggaatattagattttgttaggggagagttttattgtttattttttttttttttttttttttatatattttaaatgtattttatttaggtattttagttttgtttttagagatagttaaggttataggaagttttttttaagagaaaataatagttattaggtttttagttggatagtttattattgcggtttttgtagggattttttggattttgtattttagtttttttatttatttttatgatattttttgttttttttttgataatattttttcgggattttttattttttttgggttttaaggaggaaaggggacggaaattttatattttttttaaggttagggggtataggaggggcggttttaggtaggtaggggttaggtgtttttttttgggggtttttgaaggttatattgtggttaggtagttattttttttttttttttttatttggaggtttgtagttaaggtttttgtgttagggtttgaggaatttgcggtgttagtagcgatttttgtttatggttttttttttgttttttttttaagggaattttggttgagggaaggcgttagagaggagcggaaagggattttttagagttttttttagaagtaagttgggtgggtaggtttggagttttaaaaaaatatttgttttagggttgttttttattaggataaagtgtgtgtaaggttggtaggagtttttttttagggtttaggaaggattatttttatgttgttcgtgttatagtaaattttaagttatttttttaaaagggtaaagtggggtaatgattttttaaatttttttttgatttatttttacgagagttaaagtatagtttattcggaattgttggcgagggaagggaagtatattgttattaagtcgggattttcggtggaatgtgataaagcgtttagtgggttttcgcgttacgatttttgatagtgattattttttttttggattttggggttagaaaggggttagatggatttttttcgtagagagaaatgaaaataagcggggtgataggggtttttttttaggttaaaaaggaaatgggtgaagagaaggggcgttaggaaattttttttagtattgggtagaggtagggtttggagatagtaggaaggggtagggatggttttttggattttcgggttggggttatttcgagaggttattttttcgcggagggttggcggggggaggggtgtcgttcgttattttgggttttttattcgggtagtcgaggtttcgggaatacgcggtcggttaggttcgggttgatgtaatcggtttcgcgtcgcgcgtattcggtcgggcgggggagggcgggtatcgagcgggacgcgagcggggacgggcggggttggcgcggcgtaggtggtttagtagggagggggggttttcgtagtaatttattttaaaattttttttaaattcgcggcgagggttgaagagatcgagtggtagtgatagtaagtttttttttttttttgcgttttgttttttttacgttttttgttttttcgcggtttaaggttcgagtattttttgtttattggtttttggttttcgttttcgttgtttagatttttagttcgttcgggattagcggtcgggagtaaattttagtcggtagcggtaacgtaagtttagttttttcggttttttttttcggttttcgttttcggttggtcggtttagatcgtacgtgcggtgatttcggtgggtgggtagggttcgcgtgggcggtgagttttttttcgggtatttttttatttagcgcgcgcgttttttttttttgtatttaagacgatagagggggacgtcgtacgtttggtgtttatggattcgcgtggggtacggagtttttacgcgcgcgttcgtacgtacgtttttagtcgggagaggcgttcgtagcggttcgcggcgttagtagggtacgatcgtttattttggtatggtggaggtagagtagtaaggtaaggttttaatgtatttaagatagtagaaagtttatggtttcggaggttcgatcggggtcggcgcggttcgcgtttttttttcggttcgggttgtggggcggttcgtttttttcggcgtttcggcgagttatttttttttttcggttcgaggttcgggttagggtttggggagcgcgcgcggttggagtattgtttgcgtatatcgtcgttttattcgtttatgagttcggttttcgagcgtcgagtcgttattgcggttttttttttttttttttttttttttttttttttttttttttcggttgcggtttttttcggttcgagttagtatttttcgcggtttcgttcggttcggtttttttcgcgcggattacggttttttcgaagcgagaatagtttagaagttggacgaaaagttttagtgcgacgtcgcgagtttcgattttttttatttcgttttcgggcgcgggtttcggtttttgttcgcggttcgtcgtcgcgtttattgttcgtcgtcggtcggggaggaggtggtagttggggttgggggcggtgtttgtttgtttgttcgttagcgcgattggttagttgcgggattttaagggggagggtttacgtcgcgtttcggcggttatttttaaaagtaggttatttattttgtttttgtcgttttcgttgttcgtacgttcgcgcgttttttttgatttcgtttttttttttttcgatttttttttggagtttttgttattttttttttttttttgttggtttttaaaatttatagtgatttggggaagtagagtaatttttttaagtcgtcggttcgatttaagtggggaatggtaagtaaaaataaattaaaacgagaaataatatagttttaaaaaaaaatgtttaagaaaaaagaagagggataaaattcggattaatgaatattaaattttagtatcgagcgttttggtcggtgagttcgttgatcggtttatttaatcgttgcgtttttcgatagagcgttggtgttagtttttagcgttacgattttcgagttattcggttgttttaagttttcgcgatttttttcgttattagtcgatttttaaaaaaaaaaggggggggcgtatggtttcgtttcgtcgggatttcgttttcggttcgtttcggggggcggggataggcgagttttagtttttttatacgcggttcgggttcgggttttgcggacgtttagtgaagtttggttcgtagttcgtcgtaatgaaggggaagttcgatttttattaaggtttatagtttgaaaattatttattcgttttcggaaattttgtttagagatacgcgttcgcggggtattggcgaggagggagtaggaaagtgaggttacgtgcggatagggtttgagagtcgttttttttttgttaggaatattgaagggggtaggggaaggcggagagtcggatagggacgggtggggagagggatatatagatttattggaattttggagtgatttttggtttttttttcgttttaacgtttttaattttatacgtatatatttatttatttatatagatatatacgtttttattttcgaagacgttgttcgttttatttatttagtttttttgtggtggtcgagcgttttttagtgattgtcgtttgtatatttcggttttggttaaagagggaatgggttttggaaagggggtggggggagtttgtttttggattttttatttttgattttttaaatagttatatatttgggattggagttgttttatgtatagagagtttagggttgggtataggggttatagtgtgtttttttgataatgtgttatttggagtttttatttggtttgtagatattaaagtgagcggtagttaataggttggagtgattggggttttttgggaagtgtttagggatgttttttaggggagaagaatttggtattaagtttgtggagttgagaacgggaagttgtgtggtttcggggttagttagtgattgggagggaagaggatttgttggagtttacgtatgtattgtggagtttggtaaaatttaaagggggaggtagttgggtagatagaggtttttgtttttgttgtttttttaattttagatgttgttagggaattgaggttagggggttggtgggggcgggtggaggttagggtttgcgtgatgatttaaatttattcgttagtattaaggaacgtttgtaggttagttgtttagagtttttattaggttaggggttaaggtttttattagtttaagtttagatttatagtttattttttgaatagaaatgggggtttcgttttagtttttttatttttttaggattttttggttatttttttaggtttatagttttttttttattttttttttagtttttttttttatttttaagttttttttttttttaattttttatattttttttaagtgtttttaaaggtttttattttatttttgtatataggaagtagtttggaaaaatttttggttggtttttgatttggttatttttaggttgttttagggaataaagttggggttttgaggtttgtgggaagagtgggattagttagtttgattatttatttagattttgttagggtttggtttatagttggtatagtttttgtggaggtatggattgagaatgggaatgtagtaattttttttaatttaattaaaacgttttagggagtttatttagttagttttatttttagtatatgttgttgtggtttggtggaggtgttaggttatttttttagtatttttagttttatcggtatggtgttttaaggtttttatgaggaaaagggttggtttttatttattttaattttttttttttattattcgtgtattagttttgtttttattatttggtaggttttttagtagtagggataaggtttttgtatagttagtaaatgtttattttttggtttagggtttttttttaggtaggtttttttatttgggttttatgttttaggttgatgaacgggatatggaagggaagttattaatttttttttttgtgcgtttttagtattttaggagtataagttgtagatattttggggtaggatggaggttttgagttttaagggtttattttggtttttttttttgtatttttttttaattcggttttttttagtttttaaaagagttaatagatttgaaagagtaggttttagtaaaaaataaataaataaatttgaagttaagaggaggttggaggggttttaaggagggatagttattattagttatttcgtggttttaggtattttttatttttataagttaattgttttttatggtggtatttagtaaggtgtgttataataatttgtttgtgtttttttttggggttttgtttagggatttaggggagtgagggtatagaattttttttatataaggttaggattataatttggtttaggggtttttgagttatttttattagggcgagaaagtatggtttattttttttttttattgtggagatataatttggttgtgatttggaggggttaattttggattttatgttttagtgtgttgttatcggtatttataataatgtatttttaaggatttagttagtgtttatattgttattaaattaaaagtttaagttatttagttatttgagtttttaaaaaaggggaaaaagtataaaataataattataagattatatgtatttttgtggtatttttttttttatgggtttagttttttgaataatttgattttatttatttttatttttttttttaggttgtttgttgtaggggaaggggcgttagagtagattgtttttttaaagaatttttcgaaggtttagagagggtataaaggggtttagggttatttagtagattgggggaaggggtagtgaagtagagagtagtttatatagaggttatgttggtttttagttgaggggtaaattcggtttcgtttggagggttttattttgggagcgtagtggttattttttatagtttgtggttttgaaggtagtttagaaggagttaaggaggaaggggaaggtgttttaggtgagggggaaggggagaaaggggtgggggtggagaaaagtgcgaaaggtagttaggagttagcggcggttttagataaagaaagtagtgattgggttaaggtataatagttgtattttgttttgatgttttgttatttttaatatttagggaaattttcgtttgtgtgggtgtgggtggttaatttagaagtcggtggatgaagggataaaattttttttgagattggaaagaaggtgaggagagagttattgggttttgttgttttttatatatttttttaagtggttttattgtaatggaaggaggttttgttttttattttattttttgatttttaggtgattagtaggatattgatttgtaggaagggtaggatataaatttggtgaattgaaggagagagaattgggttggttttttttaattttttgattttgattgtgggttaatttttgttttttttttttttttttttttttcgtttaggtttttgtaataaagtattaaaaagataaagagaaagtaaaggaaagggtttttttggtttagtgttaatgttttagttttatgtggatttggaggtttgatttgaggtaatgataagtaatgatggttaattgataaaaagattggagtagaggaagttaaggagggtaatttttttaagaggatttagttaggaaagggggaaggaatggggaagaggatttagttggagagagggtagggtagagttattgtttggggaagtttatttatttatattatttttaggtttattagtttttgttttttttttatgggttttagtttaattttttgatattaagttgtttttgatgaattgtatttttttaatatttttaggtatgtttattttttgatattttaatttttgttatttttttaagtttgattttaaaatatgtttattt

SEQ ID NO: 57 - DNA, 3001 bp, Artificial Sequence
  Chemically treated genomic DNA (Homo sapiens)
tatttatggttaggaataaataaaatttagttttttttttaagaaggaggaagtattaaattttaaataagagtaggaatagtatttagaaggagaaatataatattttggaaaaagtaagtagaattaatatagtttatttaaatgtgagatttaaatcgtagtaataggaaatttttttattaaattggaattttttttaatttttgtgtaagatttaaataattaaaatgtattttaatggttattgatggttttattttttttttttttttttttttttttttttttttttttttaaagaaatagatttgagtttttttattggagtagaaatatatgaattttttttaattatttaggaaattggaagtttttgggtggatatggtttttttttattgtttttttttttttatattatttttagttaaaaaaattaattgtttttagtagagggatttttgttagaaatttttattaggtgaatttgtattgggaatttttatgtttttttagtttgtttgtgttttttaaatagagttgaagttgtaaataaagtggaaaaatatattttttattttaaaatttttaaaattttattttttgtggaaaatataattttataatattaatttttaaaatttgtaagagttatagaaggtgtgaaagtagttaaatagtcggtttagaaatttaaaagttaggattaacgggggatagaatgttttttttttaaatttaggtagggatggggagtatttttagtattagggtatttatggacgttataaggggaaaggatgtatttgaacggtgggggtgatttagcgatgaatcgttacgttaatagtattattgttaaatttttaaatttagaggttttggtgaaaaattaaatcggtggtaatttttaacgtttgtagtatttgttattttatattttagtattcggagtttggatagtttcgtaggtcgcgtttcggaggtagtatgagtttttattaatttatttatagttttattgttaacggtagttagatttaggagagatttattgaaaattttttaagatttttttttaaaaataaaacgatttttatatttaatggtttatttgaaagaatatacgtaagaaattaggagatttaaattaaatttattaataggagagtttgatgatgtttaattttagagattagagtttcgattggtgaggtttgatgaaaaagtaaagagaaatcgtaattgtatagttaaaaatataatttttgttatttttaaaattttaaaaattttttatttgtttttgggaaatgggtgaaattgaaaattattaaaataattggattttttaaaaattggattgtatgagtgaaaggtgtttatgagaagtcgatgatttcggattttattatttaagaggatagtatagaatagttaatatgttttttgagggattaggatgttgacgtttttttttgatattcgattattacgtgattgagaaaaaaaaaaaggaagttattttatgaataaaaatcggagcgtaatagtgtaataaaatattttgtatttaaaggtaataggtaggtagatgttgataaagagggttttttaaaaattatgttcggatagatttttgcgaattgtatagataaataggagtagaaggtcggttatttttgtaattagcggtagtagtagtagaagtcgtagttttagaggtagtcggagagatttcggagtagagaaggcgtcgtcgattttcgcggttgtttggttcgcggtttttataaaggcgggttagtcgttcgtttttttttttgttttttttttttttttttttgatttttttttttttttttaatcgtttgttttttttttcgggtggatttacggttattttgttttttcgcgttttattttatcgtttttttttttttttttttgtttttttttttgcgttttttttttttcgtgttacgtttttttttggttttgcgcgtttataaatttttgagtagaatacgagtttcggtaaacgagtttcgtagttttttttgttgttttcgttggtttttgcggtttttgtttagatattaacgttagacggcgatgtttttcgggtggtgattttagcgtaggaatttgaagaagcgttttgttcgtcgttttatttggtagtttttttggtagcgggaggagttgaagggtaagggagggaaaattttattaaagcgatcggtttattcgattgttgattttttcgtttggcgtcgcgttaggggagttagtttttttttagtcgggtttggttagttattgggcgtcgggtagatgtatatatatatatttttttttaattatagtaagtaagaagtggtagggcgcgtatcggttgtcgttaagtgttgtttaatttagggagtcggggtttcgtttcgtttttttttcggtttttagagttttttggggttggagggtgggaggttaggggcgtttttatagttgtgtgtttttttttttattttgcgtagaatgattatgtgtagcggagcgaggttggttttgttggtttatgggataattatgtatagtagcgtttatagtttatttgtcgtcgtcggatttcggtttttcgggattaggtaggtgttggttgtttggtttaagtaggagttggggttttttaggtatagacgtttttttacggttttttttttgtagttttttgggtttagattattagtatcgttttttgcgttttcggtgcgttttcgttagtttcggttggatagcgggtttttattttagtcgagggtttggtaggtttcgcgattgttcggacgttttttttagttttaggtagtttagggtttcgggtagagttagtgagtttttggtcgttggagaatttttttttttttaattcggtttataggatgggggtagggtacggtttttagtttggttttttttatttatttttgggacgagtt

SEQ ID NO: 58 - DNA, 3001 bp, Artificial Sequence
  Chemically treated genomic DNA (Homo sapiens)
aattcgttttaagaataggtaaaagaaattaagttaggggtcgtgttttgtttttattttgtgggtcgggttgggggagggggggttttttagcggttagaagtttattggttttattcgggattttgagttgtttagggttgggggaggcgttcgagtagtcgcggagtttgttagattttcggttagaatggggattcgttgtttagtcgaggttggcggaggcgtatcgggggcgtagagggcgatgttagtagtttggatttaaaggattgtaggaaggagatcgtgaggaagcgtttgtgtttggggagttttagtttttgtttgggttaggtagttagtatttatttgatttcggggaatcggagttcggcggcggtaggtgagttgtagacgttgttgtgtatgattattttatagattagtagggttagtttcgtttcgttatatatggttattttgcgtaggatgggaaagaggatatatagttgtgagaacgtttttggttttttattttttaattttaaaaagttttggaagtcgggggagggacggagcgaagtttcggttttttgagttgaatagtatttggcgatagtcggtgcgcgttttgttattttttgtttgttatagttagaaaaaaatatatatatatgtatttattcggcgtttaataattagttagattcggttgaaggaaagttaatttttttgacgcgacgttaagcgaaagaattagtagtcgagtgagtcggtcgttttggtaagatttttttttttttattttttaatttttttcgttgttaggagagttgttaggtaggacggcgggtaaagcgtttttttaagtttttgcgttggagttattattcgagaggtatcgtcgtttggcgttggtgtttgagtagaagtcgtaggaattagcgggagtagtaggaggagttgcgggattcgtttgtcgaggttcgtgttttgtttaaaagtttgtagacgcgtagaattaggagggagcgtgatacggagagaagggggcgtagagagagaggtagaagaaagaaagagggggcgatgaggtgaagcgcggaggagtaaggtggtcgtaagtttattcggaggaagaagtaggcgattaagggaaagagggaaagttagaaaagaaggggaggaaggtaagggagagggcgggcggttagttcgtttttgtaggagtcgcgggttaggtagtcgcgagggtcggcggcgttttttttgtttcgaggttttttcggttgtttttgaagttgcggtttttgttgttgttatcgttggttatagaggtgatcggttttttgtttttatttatttgtgtagttcgtaaaaatttattcgaatatggtttttggagagttttttttgttaatatttgtttgtttgttgtttttaagtatagaatattttgttgtattgttgcgtttcgatttttatttatgaaatgatttttttttttttttttttagttacgtaatgatcgggtattagaaaaagacgttagtattttagttttttaaggaatatattaattattttgtgttgtttttttggatgataagattcggagttatcgattttttataaatattttttatttatataatttaatttttaagaagtttaattgttttgatggtttttaattttatttattttttaaggataggtaaagaatttttagaattttgaggatgataaaagttatgtttttaattatataattacgatttttttttatttttttattaagttttattaatcggagttttggtttttggaattaagtattattaagtttttttattaataaatttaatttagattttttaattttttgcgtatgtttttttagatagattattaaatgtggaagtcgttttgtttttaaagggaagttttggaggatttttagtaaattttttttgagtttggttgtcgttgatagtagggttatgagtagattgatgagagtttatgttgttttcggagcgcggtttgcggagttgtttagatttcgggtgttgaagtgtagggtaatagatgttataaacgttgaaaattgttatcggtttaattttttattagagtttttaaatttgaagatttggtagtagtgttattaacgtggcgatttatcgttaaattatttttatcgtttagatatattttttttttttgtagcgtttataaatgttttaatgttgagaatgttttttatttttgtttggatttgaggaaaaagtattttgtttttcgttagttttggtttttggatttttagatcggttgtttggttatttttatattttttgtggtttttatagattttaaaaattgatgttgtgaaattgtgttttttataagaagtgaaattttaagaattttggggtgagaaatatgtttttttattttgtttataattttagttttgtttgggagatatagatagattgggaaagtatgagggtttttagtataagtttatttgatgaaggtttttaataggaatttttttgttggaaatagttaatttttttaattgaaaatgatgtgggaagaggaaagtaataagggaagattatatttatttagaggtttttaattttttgggtaattgaagaaggtttatatatttttattttagtaagagaatttaggtttatttttttaaaaaaaaaaaaaagaagaagaagaaagaaagaaagaaaatagagttattaataattattagagtgtattttaattatttggattttatataaaaattaggggaaattttagtttagtgggagggttttttgttattacgatttggattttatatttaaataagttatattagttttgtttgttttttttaagatattatatttttttttttaaatgttgtttttgtttttatttgagatttaatatttttttttttttaaaaaaaaaattaagttttgtttatttttggttatgaatg

SEQ ID NO: 59 - DNA, 7001 bp, Artificial Sequence
  Chemically treated genomic DNA (Homo sapiens)
tattgttttgttttgttttttagttaataatatattatgagtatatttttattttattaaatatttttttataaagttattttgatggttgtatattattttattttatgaatgtattatattaatttattttttggtgtgggttatttgattttataattttatttttagaataatgaaatatttgtgaagttttagaaaatattggtgtttgggttttaattttatagattttgatttaattggtttgggttatagattaggtattgggaatttaaaaagtttttttagtgattttaatgtgtagttaagatcgggaatttttgtagatagggatgataggaggtgagttatttttagtatttattatttagtattaatattattattttgagttgttaagtgaatgatgtatttgatttattttataaagatatatgtgtaaataaaattattataggatttggtttattagggtttgtgttttaagttttttatgttaagttatatatcgtatattaaatattttaaaatgtattttattgatatatatattaagtgaaaagtgtttttgagttaaataatgatagtataattattaagtaatgataatttgaaatgaatttattattttgtaatttagggataagttatttttttgaattttttgtattttgagagtatttgttatatttgtaagatgaagagtttgaattggttagataatgttttgtgtgtttggtatatgataggtatttaatagttttaaagaattaatgtatttagatgaattgtatattaaatttgttgttttttttttatggttttattaatttaatttgagagaaattaattattttgtaatttagggataagttatgtttttgaatattttgtagtttgaggagaatatttgttatatttgtaaaataaaataagtttgtaagttttttttttttgttttaaagagttttgtgtttttgaatataaaatataaataatcgttatgttgttaattattggtaaatgttttatttttaatttaaggaaatattataaagtaatagatatattaataaaaggttattagttaataggtattgtttgaaaagagtataaaagaattttagtatgattttttatattgtgtttttattattgttaataataaaataattagtaattatgaagtgggtggaattaatttttttaatttttttattaaattttattgaatttagaatattgtatagaaatgaatatggaataggtgagatattttgtgttttttttgttttttttttatattaaaattttttaaattataaaatttgtattaatttgttttgatttattatttatatttattattttatatggagaaaaaatatttaattgatggatatatttaaatgaaagaaaaatttgtaattttataagaggtttataaagttatagtagtgtttaatggatgaatggtttgtatgttttatgttgaattaatttttatattttaatggtatgtatattaattttgaaaaattatatatatatatatatatgtatatatatatgaatataaataaaattttatatgtgaagaagttagaattatgtttttttatataatttttttagattagtaaaatagataaaatttttgtttttaatatagaaaaatgggttattatttgatggtttgaagaagaaatattgtgattgggatatgaatggtaaatcgtagtataattatgtttaaaagaatgtttgaaatatatttttaattatttgatttttaggatagttatagtattatagtatagggaaaaattaaataattggaagataaaatttggattttagtgataggtttattataaattatgtttgttaattttattttttagttttttagtttttttttttttaagtataaaattaagatgtttaggttatttttaatgtttttttaattttgaaattgtatagttttaattgaaatataaatatttatatgtaataatgattatttttttggttgtagttgaaaatacgttttatgaagtttattttgttttttagtttttatattggatttttattaatgtattgtagagataagtttagttgatttgtaagttttgtttatataaatgtattttaaatgtgtaaagtaaggataagtaaatatttaaataaaattgggtatttttgtgagtttttaaaagtataaaagtaatttggataattttaagaaaagttatttatattgaatattaatttgatgttgaagaggttaaattgttgattaatgttttcgatattgattttttgattttttgaaattttatgagttaaattaaattagattttagaaattgaagattagtgtttgattagtgataattatatattaatttaggaattttttttattagtattaatagggtgatattataatgtttttttttttgtatattatttaaattttagtagtaaattataggtgataaaatattttatttgttgttatttgtggagagtatgttagttttttggatgtttttttattttatattttaaaaatttttaataaagaatttaaagtagtgtgttgttgttattttttgtatatttaaatttgtataaggattgttttgagttaatttatgagtattgtagttttgggttttagattttgattatattgggaatagatattgttagaggtttgtttaattattaatttttttttgtttaaatttaaaagtaattataaagaatatagatatttttaattatgggtatattatagtagatggatggttatagaaggagaaattatttttatgggaaatttatttattttagtttttaatatttatatgtatatttatggtaaaagaaaataagaaaaagattaaagtttttttttagatgatttggaagttaattttatataattttataaattaaatgtttaaatagattataatataaatagaaaataaaataaataaatgaaaaattatatttgagaaaaataagtttgttgtaggtttgttttttaaggatttatacgtatttttgttttagggttattatattttttgtttagtttgtttaagaagttatttataaggaagtaagtaaaatggtgaaagatgtattgattgtaattgagaaatttattggagatgaatagtttttagggtgtttagaaaattaggtgagtgaataattttaaaaaagtattgtgatatttgataaaaatttagtatgttgaagagaagatataaaaatagtagtgaaaaatgtatttaaatatttgaagagttattgtatgaaagagggattagatttattttgaattgttaaagagggtagaagagaataataggtagttattataaagagattatataaatatgatgaattaaggttttgaaataagattattttgatgattatgggtatattaatttttttgagttttagtttttttatttgtaaaataagggatgataatagtttttattttatagttagtatggaaattgatataatagtaatagtagttaatttttattatatatataatgtgattggtattattttagggagtataatgtgtatattgataataaaaatattttatgatataggggatagatagtattgatgaattagaatggttgtttagtgagttaagagatgttggttcgggtttttgggtaggatattagttttgtttatttatatttatttattaaatatttaaaataatttttgaagatagatgttaattttttaattgaggaagttgaggtttagagaatttaagtaatttttttatgggaattattaaatggtagagttaggatttgaattagattatttggtttaaaattgatagttttagtagttttattatattataattatagtgaatgtaagatgtatagtatatcgttagggttgttaggtttagtaaataataataaaatataatatttagtttaatttgaattttagataaatattaaatattttttttagtataaggatattttattgtagaagtttaataaataatatttattatttattttattttaatatagaaataaatttgataatgattagaattttttaattataaaataatatgtttagagaatattttgttatggtggggttaattaggtggttgaaagataatgtatttggaatattatagaagagatgtttttttaaggatatagtttaagttttttttaattttgaaatttatgaattgataaaaatttttgttttgtatttttatttttgttttgttttgataatttttttaaaatgtgtataaaaaaataagaatatattatttattgtaattttataattaattagaggtttaaggtaatgttatagatcgttgatttatttttgtaaatttaaaggtatgttttttaaatgaggattgggaattagaaattttacgtaagttttttaggattttttaaatattattgtagtagttataaaagttatataaaagtttttttagatatatgaaatatatgtattttttagatgttttttgtggaatattgatgttgttatttgagtttggtaagggtaagttatagaggaggaaatatatatattttaaaatattttagttaaatatgtaattgtggttaagaaaagtgtttttttaaaaaataattattttattttaaaattatttttatttataattgaaaataatatgtagttttttattgttttgtaaggatggtatgtaaaatgagtatttatgtttgaaatgtggtatgtttgtgtgtgtgtgtgtatatgtatatatgtatgtatatattataatatatatatatgtatttgtaattttaaaagttatatttttaatgagaattatgaaaatattattttgtttagtttttttttttatttaaatttaaatttaaagttttggtgtatacgggtaggatgagtaggtttgttatataggtaaatacgtggtatggtggtttgttgtatttattaatttgttgtttgggtattaagtttagcgtgtattatttattttttttaatgttttttttttttgtattttattttttgataggttttagtgtgtgttgtttttttttttgtgtttatgaaatatggtttatatatttataaaagtttatatattttagtttaaatttttgataatataaaaaggaaaaataaaataatttaaaattgggaaagagaaataaaagattgtatggtttttttttttttattgtttggatattaaagttttattttttataaggtagtaaagaaatttattttattaggttgaaataaaatatattagaatttgtatggaaaattttttagaatttatagttttgattttagatattagaaaatgttttatgtgttttatagatttttaaagtaaagttagttgtttttttttaaatataaaatattttttatagttatttgtttttttggaagaattttgttatgagaaagaaattttggagaagtacggatatttagattgttgtagttaaagtgaagagggaagatataattgtttttttgtatataaaaagtttattttagtatcgattttatttttttaagttttagaatttgttataagttgtgaagtatatgaagaagatagggagatatttatgaataagtaaggatttagtttaaaggtagatgtaaattttagaaatatagtaatggtaagtttaatttagtatttttgtaatgtatttatgtatttttagtaagaggtataatgtttttttggtgttgtgtttgttgaggttttaggtaaggtaattaggagagtaatatttaatgtaatttggtttttatagtacgttagatgtagtataaattataggataaatttattagaggttttattagttttttgagagatatatattttttttttttttttttatttattttatttttaattttattttgtttaagaatatattagtattgtattaaattgatgttttttagagttatatattggtgttttgtgtttatttaattgtttagaaataaaagttagagatttaagtatggttaagtatggttaagatatatagatatggtaaaggtttattgaatatttaggatgttgtggggtcgggcgcggtggtttacgtttgtaattttagtattttgggaggtcgaggcgggcggattacgaggttaggagatcgagattattttggttaatatggtgaaatttcgtttttattaaaaatataaaaaaaattagtcgggcgtgatggtgggcgtttgtagttttagttattcgggaggttgaggtaggagaatggcgtgaattttggaggcggagtttgtagtgagtcgagattgcgttattgtattttcgtttgggttatagagcgagatttcgttttaaaaaaaaaaaaaaaaaaaaaggatgttgtggaaatatgtttgtttgtatagaggattagattaatatttataaataaattttgaagttttttttttttttttttttttatttttttttttttttttattttgttgataggaaattgaaggttggaaggttaaaataattggttaagggtatatagttagtatatttgattttaggtttttttgttggagaagtttgtacgtaattttttaattatttttgttttttatgttattttttaaattagataaatagagagattgtttttagaatatttttgttatggcgattatttaggtgtataattttattttgtattgataagggataaaatgtttatttttttgttgtatttagtagaagtttggttttgttgatttttgaaatatatttgagtaggtttattgaaaaagattttttaataagaattatggttagtatgtttgtttattttttttttataatagaatttggtattatttgttagata

SEQ ID NO: 60 - DNA, 7001 bp, Artificial Sequence
  Chemically treated genomic DNA (Homo sapiens)
tatttgatagatggtattagattttattatgagaagaaaataggtagatatgttaattatgatttttattaaaaggttttttttaataagtttatttagatatgttttagggattagtaaagttagatttttgttaagtgtaatagaaagatggatattttattttttgttagtgtagaatggggttatgtatttggatagtcgttatagtagagatgttttaagggtaatttttttatttatttggtttaggaagtaatatggaaggtagaagtgattgaagagttacgtataggtttttttaatagaagaatttggggttaaatgtattagttgtgtgtttttagttagttgttttagttttttaatttttaattttttattaataaaatgggggaaagaagaagaatgaagaggaagaggagaaggaggttttaaagtttgtttgtgagtgttaatttgattttttgtgtaagtagatatgtttttataatattttttttttttttttttttttttgagacggagtttcgttttgtggtttaggcgggagtgtagtggcgtaatttcggtttattgtaagtttcgtttttagggtttacgttatttttttgttttagtttttcgagtagttgggattataggcgtttattattacgttcggttaattttttttgtatttttagtagagacggggttttattatgttagttaggatggtttcgattttttgatttcgtgattcgttcgtttcggttttttaaagtgttgggattataagcgtgagttatcgcgttcggttttataatattttaagtgtttagtaaatttttgttatgtttgtgtattttgattatgtttgattatgtttggatttttaatttttatttttaggtaattaggtgaatataaaatattaatatatggttttggaaagtattaatttggtgtaatattaatatatttttgaataaggtaaaattgagagtagaatgggtaaaaagaaaaaaaaaaggtgtatattttttaagggattaatggaatttttggtaggtttgttttgtggtttgtattatatttagcgtgttatggaaattaagttatattgaatgttgtttttttaattattttgtttgggattttagtagatataatattaaagaaatattatattttttattgggagtatatgagtatattgtaaaaatattaaattaggtttgttattgttgtgtttttgaggtttgtatttatttttaaattggatttttatttgtttatgaatgtttttttgttttttttatatgttttatagtttgtgataggttttggaatttggaaaagtgggatcgatgttggagtgggttttttgtgtgtaagaaaatagttatgttttttttttttattttggttgtagtagtttgaatgttcgtatttttttaaaattttttttttatggtaaagtttttttagaaaggtaggtagttataagaaatattttatgtttggagaaagataattaattttgttttaaaaatttataagatatatgaaatattttttaatgtttaaaattagaattatagattttgaaaaattttttatataaattttaatgtattttgttttagtttgatgaaatagatttttttgttgttttatggaaaatgagattttaatgtttaaataataaaaggaaaaaagttatgtaattttttgttttttttttttaattttgaattattttattttttttttttgtgttattaaaaatttggattaggatatataaatttttataaatatataaattatgttttatggatatagggagggaaatagtatatattggggtttgttagggagtggagtgtagggagggagagtattaggaaaaataggtaatgtacgttgggtttaatatttaggtaataggttggtaggtgtagtaaattattatgttacgtgtttatttatgtaatagatttgtttattttgttcgtgtatattagaattttaaatttaaatttaaataaaaaaagaaattgagtaaaataatatttttatgatttttattaaagatgtaatttttggaattgtaaatatatatgtatatattatggtatatatatatatatatatatatatatatatatatatagatatattatattttagatataaatgtttattttatatgttatttttataagataataaaaaattgtatattatttttaattataaataaaaatgattttgaaatgaaataattattttttaaaaaaatattttttttggttataattatatatttagttaaaatgttttaaaatgtatgtgtttttttttttgtgatttatttttattaaatttagatgatagtattaatattttatagaaagtatttgaggaatatatgtgttttatgtatttgagggaatttttatgtagtttttatagttgttatagtaatatttagagaattttggaaggtttacgtaagatttttaatttttaatttttatttaaaagatatatttttgaatttataagaataaattagcgatttgtaatattattttgaatttttaattggttgtaaagttgtaatagataatgtatttttgtttttttatatatattttgaaaagattattagaataagataaaaatagagatgtaaaatagaaatttttgttaatttataaattttaaagttggaaagaatttaaattatatttttaaaggagtattttttttatgatattttaggtatattgttttttagttatttaattaattttattataatagagtattttttgggtatgttgttttataattggagagttttaattattattaagtttgtttttatgttgagataaaataaataataaatattatttgttgagtttttataatgaaatatttttatattaagaaaagtatttagtgtttatttaaaatttagattgaattgggtattatgttttgttgttgtttgttaaatttggtaattttaacgatgtgttatgtattttatatttattatagttatagtgtaatgaagttattaagattgttaattttaagttagatggtttagtttaaattttggttttgttatttggtggtttttataagaaagttatttaaattttttgagttttagtttttttagttggaagattagtatttatttttaaggattattttaaatgtttaataaataaatataggtaagtaaagttgatattttgtttagaagttcgagttagtattttttgatttattggataattattttgatttattagtgttatttattttttatgttataaaatatttttattattaatatatatattatgttttttagaataatgttagttatattgtgtgtataataaaagttagttattattgttgttatattaatttttatgttaattatgaaatgggagttattattattttttattttatagataagaaaattgaagtttaaaaaagttaatatgtttatagttattaagataattttattttagaattttagtttattatatttatatggtttttttataataattatttattgtttttttttgttttttttagtaatttagaatgaatttaattttttttttatataatagttttttaaatatttaaatgtattttttattgttatttttgtattttttttttagtatgttaaatttttgttaaatattataatgtttttttaaaattatttatttatttggttttttaaatattttgaagattgtttatttttagtgggttttttaattgtagttaatgtattttttattattttgtttatttttttgtaagtggttttttgaataaattgggtaaaaaatatggtagttttgaaataaaaatacgtgtgaatttttaaggaatagatttgtagtaagtttattttttttaagtatagttttttatttgtttgttttgttttttatttatgttgtaatttgtttagatatttgatttgtaaaattatgtaaaattagtttttaggttatttgagaagaaattttagttttttttttgtttttttttgttataaatatatatatagatgttaaaggttaaaataagtggattttttataagagtggtttttttttttgtgattatttatttattgtaatgtatttataattgagggtatttatattttttatggttatttttaaatttaagtaaaaaaaaattggtaattagatagatttttaatagtgtttatttttagtatgattaaggtttaaaatttaagattatagtgtttatggattgatttaaagtaatttttatgtaggtttggatgtgtaaggagtaatagtaatatattattttaaattttttgttagaaatttttaaaatgtggaatggaaagatatttaagagattaatatattttttataaataatagtaaatagaatattttattatttatggtttgttgttaagatttaaatagtatatagaaaagaaaatattataatattattttgttggtattgatgagaaaaatttttgaattagtatatggttgttattgattagatattaatttttagtttttaaaatttgatttggtttgatttatgagattttaaggaattaaaaggttaatgtcgaagatattagttaatagtttaatttttttaatattaagttgatatttagtatgagtaattttttttgaaattgtttaaattgtttttgtgtttttaagagtttataggggtatttaattttatttaagtatttatttatttttgttttatatatttaaagtatatttatataagtaaaatttataggttagttaaatttatttttgtagtatattggtaagaatttaatatggaagttggaaggtaaaataaattttatgaaacgtgtttttaattgtaattaagaaagtaattattgttatatatgaatgtttgtgttttagttagaattgtatagttttagaattaaaagaatattagggataatttaagtattttaattttatatttgaggaaaagaaaattaggaaattaaggaatgaagttaataagtataatttatagtagatttattattaaaatttagattttgttttttagttgtttggtttttttttgtattgtagtgttgtaattgttttgaaagttaaatggttaaaaatatattttaggtatttttttgaatatagttgtattacggtttgttatttatattttagttataatattttttttttagattattaaataatgatttatttttttgtattaaaaataaagattttatttattttattagtttgagggagttatgtgaaggagtataattttggtttttttatatataaaattttatttatatttatatatatgtatatatatgtgtatatatataattttttaaagttaatatgtatattattgaagtgtaaaaattaatttaatatgaaatatataaattatttatttattaaatattgttataattttgtaaattttttgtaaagttataagttttttttttatttaaatatatttattagttaaatattttttttttatgtggaataataaatatgaataataaattaagataaattaatgtaaattttataatttaaaaaattttgatatagagaaaagataagaaaaatataaaatattttatttattttatatttatttttatgtagtgttttggatttagtaaaatttagtaggaaaattaaaaaaattgattttatttattttatggttgttagttattttgttattggtagtggtggaagtataatatggaaaattatgttgaaatttttttatattttttttaggtaatgtttgttaattagtaattttttgttggtatatttgttattttatggtatttttttaggttgaaaatgggatatttgttaataattaatagtatagcggttatttgtattttatgtttaaggatatagagttttttggggtagaaaaaaaaaatttgtaaatttattttattttgtaaatataataaatattttttttaaattatagaatatttaaagatatgatttgtttttaagttgtagaataattaattttttttaaattaagttaatgaagttataaagaaaagatagtagatttggtatgtaatttatttaaatatattaattttttaaaattattaaatgtttattatatgttaggtatataagatattgtttgattaatttagattttttattttgtaaatataataaatatttttaaagtataaaaaatttagagagatgatttgtttttaagttgtagaataataaatttattttaaattattattgtttgataattatgttgttattgtttagtttagaaatattttttatttaatatgtatgttaataaggtatattttaaagtatttagtatgcgatgtatggtttaatatagaaaatttagagtataagttttaataaattaagttttataataattttatttgtatatgtgtttttataaagtgggttaggtgtattatttatttagtaatttaagatgatgatgttaatattaaatgatggatgttaagagtggtttattttttattatttttgtttataagggttttcgattttggttatatattagaattattgggggaattttttgaatttttaatgtttagtttgtaatttagattagttaaattagaatttgtggagttgagatttaggtattagtattttttaaagttttataggtgttttattattttaaaggtaagattataaaattaaataatttatattaggaaataaattaatatggtatatttataaagtagggtgatatatagttattaaaataattttgtggaagaatatttaatgaaatggaaatatgtttataatatattgttaattgaaaaataggataaaataata

SEQ ID NO: 61 - DNA, 2001 bp, Artificial Sequence
  Chemically treated genomic DNA (Homo sapiens)
agtttttgaataaaaataaatattgttaaattgtttttaaggaaggttttttaatttatttttttattagtaatataggagagcgtgtggtttatattaataaaaagaattttgttgttttgagtagtattaagcggagcgtttaaatttatatttttttgattaggaaggttgatattcgtttttgtaatttatattttttttttattgaattgtttgtttttattttttgttcgtttttttatagggatattattttatttttttagtgttgtttttataaaataaataatttttttgtttgttttttttttcgagacggaattttgtttagttgtttaggttggagtgtagtggcgcgatttcggttttttgtaatttcggtttttcgggtttaagcgatttttttgttttagttttttaagtagttgggattataggtacgcgttattattatgttcggttaatttttgtatttttagtagagacggggttttattatgttggttaggttgatttcgaatttttgattttaggtgattcgttcgtttcggttttttaaagtgttgggattataggcgtgagttattgtattcggtttaataaatgttttagaaagttatttggatgatagtttatgattgttgaatatcggttgaggtttataaaattgcgtttatcgtttggggattttttagtcggtttttattttttatggaaagcggtttttttataaatttttacggtgggaattattgtaaaggtatcggttttttcggtttcgaatatttcgcgggattttagttgtttttgggtattttttttagcgtaattattaattttaatatgtaacgcgtttcgtggtttaagtattcgaatgaaggttcggggttaaagttatgtgtttgattgcgttatacgtttcgttattttttttacgtttttttttttagcgtatattttggtcgttattttgtgcgcgaggttatggaatttttgagtttcgttaattttatggtcgagcgttttagggatcggttaatcgtaatttagatttcgtaggaaagtttcgtttttattcgtatggaggcgggaattgttacgaagtttttgtggagggagaggaagtagttgcggaaagttaataagagtggggaatcgatgacgttaattaatggggacgcggggatattacggttaatgagaatggagaaggtttaggatacgtgggtgggggaagttgagggttgagattaagggttaaagttgggaggtgagtttgttattttgagtcgggcgagcgttgtgggttaagtaggggttgtagggtagtaggagtgtaggtgatttggggtcgggagttagtaataggtagggttgtgggttgcgtagtgtggaggggtatttttttttagtgttgggagaggttatggtaatttagatatggttttattaatgaatgttaattattaacggtaatgaacgattgattgtttcggttggggcgggtcggggattgttgtgtaagatgggtaggattttgcgcgatatttgtttagtattcgtttttagttttttcgagagattattttttttcgtaatattttttttttggggtttgggtatatttttttgattttcgatttttatgattttgttttgaagatttattgttttgtttttttgatttttaatgttttttttagttggggtacggtgtaaggaagagcgtggtttagggaggacggacgggggtgaaggggacgattaaaggtcgttattataagtaaataattagggttttagtgggattattattattattttttttttttttgtagattgaaaaaatgtagatcgtcggggtattatttatttttttagttttggtaaggtgtcgcgtcgcggtgttttgtagtattaggtgtatggtgtggacgttattagtgtttaatgaatgaatttaggggagtttggcgttttgatgatgtaggttttttg

SEQ ID NO: 62 - DNA, 2001 bp, Artificial Sequence
  Chemically treated genomic DNA (Homo sapiens)
taaagagtttatattattaggacgttaagtttttttgggtttatttattaaatattgatggcgtttatattatatatttggtattatagagtatcgcggcgcggtattttattagagttggagaaatgaataatgtttcggcggtttgtatttttttagtttgtagagggggaaaaaatagtaataataattttattgagattttggttgtttgtttataatgacgatttttggtcgttttttttattttcgttcgttttttttagattacgtttttttttgtatcgtgttttagttgaggagggtattagaggttagagggatagagtagtgggtttttaaagtaaagttatggagatcggaagttaaggaaatgtgtttaagttttaggaaggaaatgttgcgaaagggaatggtttttcgggaagattggaggcggatattgggtaggtgtcgcgtaggattttgtttattttatatagtagttttcgattcgttttagtcgaggtagttaatcgtttattatcgttggtaattaatatttattgataaggttatatttagattgttatagttttttttagtattggggggaaatatttttttatattgcgtagtttataattttgtttattgttggttttcggttttaagttatttgtatttttattgttttgtaatttttgtttggtttatagcgttcgttcggtttaaggtgatagatttattttttagttttagtttttggttttagtttttagttttttttatttacgtgttttggattttttttatttttattggtcgtaatattttcgcgtttttattggttgacgttatcgattttttatttttattggtttttcgtagttgttttttttttttttataggagtttcgtggtaattttcgtttttatgcggatagaggcggggtttttttacgagatttggattacgattggtcgatttttgaaacgttcgattatagagttggcgggatttagaggttttataatttcgcgtataagatggcgattaaggtgtacgttgaagaaaaaggcgtgggagagatgacgggacgtgtgacgtagttagatatatgattttggtttcgagtttttattcgggtgtttgggttacggggcgcgttgtatgttgggattggtagttgcgttgaggggggtgtttaaggatagttgagatttcgcgagatattcgaggtcgggagagtcgatgtttttgtagtaatttttatcgtggaggtttgtggaaagatcgttttttatggagagtaaaggtcggttggaaagtttttaagcggtgagcgtagttttgtggattttagtcggtgtttagtagttatggattattatttagatggttttttaaaatatttgttgggtcgggtgtagtggtttacgtttgtaattttagtattttgggaggtcgaggcgggcggattatttgaggttaggagttcgagattagtttgattagtatggtgaaatttcgtttttattaagaatataaaaattagtcgggtatggtggtggcgcgtgtttgtaattttagttatttgggaggttgaggtaggagaatcgtttgaattcgggaggtcgaggttgtagggagtcgagatcgcgttattgtattttagtttgggtaattgagtaggatttcgtttcgggggaaaaaataaataaaaaaattgtttattttgtaaaaataatattgaaagaatgaaataatatttttatagaaaaacgagtaaaggataggaataggtaatttagtaaggaagaaatatgaattgtaggaacgaatgttagtttttttaattaaagaaatataagtttaaacgtttcgtttagtattgtttaaaatagtagagttttttttattaatgtgagttatacgtttttttatattgttggtgagaggatgaattagaaaattttttttgaaagtagtttggtaatatttatttttatttaaaggtt

SEQ ID NO: 63 - DNA, 1451 bp, Artificial Sequence
  Chemically treated genomic DNA (Homo sapiens)
tagaaatagggttttattaggtttcgaatttttgggtttaagtaatttgtttgtttcggttttttaaagtgttgggattataggtgtgagttatagtgtttggttaaatattttattttttagattataagatgtttaattttatttttggtaaaaagttgatttagtaaattagggttttaagtgaagtcggttggggtttgaatttttgatatttgtttagggtggaagatatagtagttgtatttatgggttatttggggtgtagggtgattagttggaggttgtgagtttttttgttttttgaaatgtttgtacggggtatttaggaagggttggggattgggtgaggaggtgtggatagaatgttttttggaaattgttttaggggtagtttgagtggtttgagttgtgtttgttttattgaaggttggagttttagagaaaagtttttatggacggatttattttttagaattgttgtttttgcgggagaatatttttttttaggtgttgtttttagggtagtagggaagattgggaaaaattgaggggtaagagttgttggaggggggagttatatttattgagtgtttattatatgtcgggtgttgttgaaggtttgcgggttttataggatttttttttagatttttatatttttgtagattatacgtcgtttatagatgattttgaatttagaagggttgtttaggtttagggtttagttagtgagtggatgggtagaattagatttgttttggaagggtttgttttattttggcgtttaaaatgtgttttttattttttgttattaggataagtaaattcgagtattttttcgttaggggtttaagtttattatgggtttgatttttaaggttatattttcgtttttttatttgatagataggaaatttttgaaatgtttttcgtacgtgtaagacgttttcgcggtggcgggcgatagagggcgtatagtgggatcgtagtacgagttcggagtatttttagagtcggcgatttttgttttcgtttttgtcggtcggttttttcggggtttaggagggtagtatcgtcgggtttcgcgttatgatattagttttggagtggtgtagtgtgtaaagtttattggttggcgtggttcgggatacgttttcgcggagcggaataaaacggcgcgtaggtcgggcgtatttagtcgttattttcgagagcgtttgtcgtttttgcgtcgtcgagttagttgttaggtgagtgcgttttgagtcgcgcggttttgttcggcgcggaggggcgtttgggtacgtatttagcgtttttcggttttgttagtttcgtcgtagtttcggggttgtcgtaggcggggaattgtgagaagtgatcgtagttagttcgggtagtgttgtttttttttggaggtattaggttcgtttttatttcgggttttt

SEQ ID NO: 64 - DNA, 1451 bp, Artificial Sequence
  Chemically treated genomic DNA (Homo sapiens)
gaaggttcgggatggggacggatttagtgtttttagaaaagagtagtattgttcgggttaattgcggttattttttatagtttttcgtttgcgatagtttcggggttgcggcggggttggtaagatcgggaggcgttgagtgcgtgtttaggcgttttttcgcgtcgggtagagtcgcgcgatttagggcgtatttatttggtagttggttcggcggcgtaggggcggtaggcgttttcggaagtggcggttgggtgcgttcggtttgcgcgtcgttttgtttcgtttcgcggaagcgtgtttcgggttacgttaattagtgggttttgtatattgtattattttagggttgatgttatggcgcgaagttcggcggtgttgtttttttaggtttcgggaaggtcggtcggtaggggcgggggtaggagtcgtcgattttgggggtgtttcgagttcgtgttgcggttttattgtgcgttttttgtcgttcgttatcgcgaaaacgttttgtacgtgcgaggggtattttaggagttttttgtttgttaggtgagaaggcggagatatgattttagaggttagatttatgataaatttgagtttttaacgaaagggtgttcgaatttatttgttttggtggtagagggtgagggatatattttgggcgttagggtaagatagatttttttagggtaggtttgattttgtttatttatttattagttgggttttgggtttagatagtttttttgggtttagggttatttgtgaacggcgtgtaatttatagggatgtgagggtttaaaaggagattttgtaggattcgtagatttttagtagtattcggtatgtaatagatatttaataaatgtaatttttttttttaatagtttttgttttttagttttttttagttttttttgttattttaaggataatatttggaaaaaggtgttttttcgtaaaagtagtagttttgaaaagtgggttcgtttatagaggtttttttttggggttttaatttttagtaggatagatatagtttaggttatttaagttgtttttggggtagtttttaggggatattttgtttatatttttttatttagtttttagttttttttgagtgtttcgtgtaggtattttagggagtagagaagtttatagtttttagttggttattttatattttaggtggtttatagatgtagttgttatgttttttattttgggtaggtgttaagggtttaggttttaatcggttttatttaaagttttggtttgttgaattaattttttgttaggaataaagttaagtattttatgatttagaaaatgaagtatttggttaggtattgtggtttatatttgtaattttaatattttgggaggtcgaggtaggtagattgtttaaatttaggagttcgagatttggtgaaattttgttttta

SEQ ID NO: 65 - DNA, 771 bp, Artificial Sequence
  Chemically treated genomic DNA (Homo sapiens)
tgtcggtaaatttgttgatttaggttttacgagggagtaagtaatattggatttttttcggtatttcgagaatggggtgggggcgtttttaaaggatttttttttttttttagtgtttgtttttgttttcggttcgttttttgttaagatttggggatttttagggtttggagggaaagttttttgggacgattatagagcgttagtattgaattagtttggagagcgcggaaggaaagggtcggttcgtagagggcgcggggaaggtagggtggggacgcggtggagttcgcgttcgtttgttgaaggtttggaagtgtagcgtagaagatagagggtgattaggaagacgcgcgaacggggttggtcggtcggcgggtgggggaggggaggcgggggaaggcggttgagtgggtttttggagtgtgtgtgtttgtgttagtgtgtgtgtgtgtgtgtgtatgtgtgtgtttggcgtttggttagggtgattttttataaattatatgttttttagtttttttttaaaaggttgtgtcgagggttggttagtgaggttcggttcggggaaagtgaaagtttgtttgggttttttcggcgttagagtcgtttttcgtattttaggatagcggtgcggttttcggtcggggcgtttatttcgtagtagttagcgagcgagcgagcgagcgagggcggtcgacgcgttcggtcgggatttagttgttcgtatgatcgcgtcgggcgtcgtcgggcgttgtttttttacggtaa

SEQ ID NO: 66 - DNA, 771 bp, Artificial Sequence
  Chemically treated genomic DNA (Homo sapiens)
ttatcgtgggagggtagcgttcggcggcgttcggcgcggttatacgggtagttgggtttcggtcgggcgcgtcggtcgttttcgttcgttcgttcgttcgttggttgttgcggagtgggcgtttcggtcgagggtcgtatcgttgttttgggatgcggagagcggttttggcgtcgagaggatttaggtaaatttttatttttttcgggtcgagttttattggttagttttcggtatagttttttaagagaggattggggggtatgtggtttatgggaaattattttggttaggcgttagatatatatatatatatatatatatatatattgatatagatatatatattttagaggtttatttagtcgttttttttcgtttttttttttttattcgtcggtcggttagtttcgttcgcgcgtttttttagttattttttgttttttgcgttgtatttttaagtttttagtaaacgagcgcgggttttatcgcgtttttattttgtttttttcgcgttttttgcggatcgatttttttttttcgcgttttttaggttgatttagtgttagcgttttatgatcgttttaagggattttttttttaggttttgaaaatttttaaattttagtagaaaacggatcgagagtagggataagtattgggaagggagggaaattttttgaagacgtttttattttattttcggagtgtcgaaaggagtttagtgttatttgttttttcgtggagtttgagttagtaggtttgtcggta

SEQ ID NO: 67 - DNA, 2580 bp, Artificial Sequence
  Chemically treated genomic DNA (Homo sapiens)
gaattcgagtttataagtttttttaaaaaaaattgatttaagtaaattttgggaagagtttttttgttatataatttaaggttttaaggttttcggatttatatattttataaatgaattagttagtttgtttaaatgtagggaaattgtgggaagaatgttttttttatttaatttaaggttttaaggtttttttaattaattttattagttaattagttaattatttaaaaataaaagtttgaaattgttaaaaaaaaaagataaggaaaaggaaagaaagaaagttattagtttgtttggtatataatatttaattgttgtttgatttacgtgtgggttttagatgtagatttttagtttttagttttttagagattgatattaggtttgttatacggtttaaaatgatgagtatatttatgaattttaattttatttttttttagatttttttggttaagaaattatgtagtttgtatgaagtaggtatttaaaatatatttgatgatttaatttttattggagaagaaatatttatatatgtttttttatttttatatgttttaaatatgtaaagattaaataaatatttttagaagtatttaaattttttaaagtaaatttattttaattagtaataggatttttttaatattggaaagttgagtgtgatcgtatttagtggtgataagtgtgagtttgtttggggagagggtaggatatttaggattttttaagtttagagttaatataataaagattattgagtgtttatttgggtgggttataattattgtttataggagtttatgaattataagtaaaagagtgaggagatatgattagtttataaataatttttaatatagagtagaaagtaatgaattattgtaatggagttattatagtgttaaggatgtttagagggtatttttgataggtagaggtgagggttagggaaggaagttgtagtttagttagttagagttgttggaatagatatgataatgttgttgttaaattgtttttttttttgaggatagaatgtttcgtgtaagtggtttggtggaagggattagtgttttaatatagggtgatttataagtaggaaagtgtgttttagaaatttagattagagtgatagattgaattggattatgggggatttatttgaatgttatttattgtattgtttttgcgattagtgttagtaaagtgttaaagggattgagtagatgagtgatattatgtaatataagttttgagttttatttgttagattgattggagaggggtttggttagttataggaaggtaatttggtatgtagttattatttttgagttgatgtaagtttttttgtatggagagttggttttttttattttgtgggaaaagagaataaaggagtatgggagtgtttaagggaaggagaaataaagggtagagaggtagcggtggtgttagggaagtttataggagttaatagtagggttgttttaatttagagaggaagcgatttggtgttttcggttttgtggttttttttatttaataatattttttattttataataatgttagggaaggcggaggttggtatagtgtattaagatatagttatttttgggtgatagaggtttagggtagtttattaagtaggtagaagtttttgatatatattttgagagataaagtaagattttgtattttaatttttagaattttttttattatttattatagtttcggagttatatagtttttattattttattataattttagaatattagagaatatattattttatttaattattttttattatatgtgaaaaaaatgaaggatatgggggaagtgtgatttgttttaaattatatattttatggtagagttaggttttttgtttgttatattagtgttttttttgttataattattttgaagaatttattttttagtaagaaaatatttttatggagagtagttggaaaatagttgagagatggaggggaggttgggggtgtggagaggggaaggggtaagtgtatagattcgttgaaggggggagaaaaggtcgtggggatgaagttagaaggtagaagggtttgttgggtttggtatgaaggagtatgagtttattgagttttttttggtttttttatgttagtaatgtacgtggtttagtttgttgtggtattggttagtagtcgaggtatcgttagttttgtgtgtgagtatgtatttttaggtaaagttattgaggttcgggtgatagtgtttcggtaggttgatagttaggtgattgaagtttgtgcggtaatttatatgatggggaatgagttgatttttttagatgattttatttgtacgggtatttttagtggaaattaagtgaattttattatttaaggattgagggttatggatacgggattttatatttgtaaggtggagtttatgtatttatcgttatattatttgggtataggtaacggagtttagatttatgtaattggtgagtaaagttattttattgagttgatatttgttgtattgtagttttttatgtat

SEQ ID NO: 68 - DNA, 2580 bp, Artificial Sequence
  Chemically treated genomic DNA (Homo sapiens)
gtgtatagaagattgtaatgtaataggtgttaatttagtgaaatggttttgtttattaattatataaatttgggtttcgttgtttatgtttaggtagtatggcggtgggtatatgagttttattttgtagatgtagagtttcgtgtttatggtttttagtttttggatagtgaggtttatttgatttttattggaggtgttcgtgtagatggaattatttaggaaggttaatttattttttattatgtaggttgtcgtatagattttagttatttggttgttagtttgtcgaagtattgttattcggattttagtggttttgtttggagatgtatatttatatataaagttggcgatgtttcggttgttggttagtattatagtaggttgggttacgtgtattgttagtatggaaaagttaaagggaatttagtgaatttatgtttttttatgttaagtttagtaagtttttttgttttttagttttatttttacggtttttttttttttttttaacgaatttatatatttatttttttttttttttatatttttagttttttttttattttttaattgttttttagttattttttataaagatatttttttattgagaaatagattttttaagatggttgtggtaggaagaatattgatatgataaatagaagatttggttttattatgaaatatgtgatttggggtaagttatattttttttatgttttttattttttttatatatagtaagagataattagatgagatgatatgttttttggtattttaaggttatgatagaatgataggagttatatagtttcggaattataatgagtggtaggggaaattttgaaggttgaggtatagaattttgttttattttttaaagtatatgttaaaaatttttgtttatttagtgagttgttttgaatttttgttatttaggagtagttgtgttttgatgtattgtattagttttcgttttttttggtattgttgtagagtggaagatgttgttagatgaaggaagttatagagtcgagggtattaggtcgttttttttttaggttgaggtaattttgttgttaatttttgtgggtttttttgatattatcgttgtttttttgttttttattttttttttttttgaatatttttatgtttttttgttttttttttttataggataaaggagattagttttttatatagagaggtttgtattaatttaaaaatagtggttgtatgttaaattatttttttgtaattaattaggtttttttttagttagtttgataagtgaaatttaaaatttgtgttgtatgatgttatttatttgtttaatttttttgatattttattaatattgatcgtaaaaataatataataaataatatttaaatgagttttttatgatttaatttaatttattattttggtttgaatttttaggatatatttttttgtttataaattattttatattagagtattagttttttttattaagttatttgtacgggatattttgtttttagaagagaaaatagtttggtagtagtattgttatgtttattttagtagttttagttagttagattatagtttttttttttaatttttatttttgtttattagagatgttttttgagtatttttagtattgtgataattttattgtagtagtttattattttttgttttgtattaaagattatttgtgagttaattatatttttttatttttttatttgtggtttatgaatttttgtgagtagtgattatagtttatttaagtgagtatttaataatttttattgtattgattttaagtttaagaaattttaaatgttttgttttttttttaagtaagtttatatttattattattaaatgcggttatatttaattttttagtattgggagggttttgttattggttgagataaatttattttaggaaatttaaatatttttaagagtgtttatttaatttttatatatttaaaatatgtaaaaataagaaaatatatatgaatattttttttttagtaaaaattaaattattaaatatgttttgagtatttattttatataaattatatggttttttagttaagaaggtttagagagagataaggttgagatttatggatatatttattattttaagtcgtgtaataaatttggtgttagtttttgaagagttgaaaattgaggatttgtatttgaaatttatacgtaggttaggtaataattaagtattgtatgttaaatagattggtggttttttttttttttttttttttgttttttttttttggtaattttaaatttttatttttaaataattggttaattagttagtagaattgattaagagaattttaaaattttgaattaagtaaagaaggtattttttttataatttttttatatttaaataagttggttaatttatttataaagtatatgaattcgaggattttaaaattttgaattgtatagtaaaaaaattttttttaggatttgtttaagttaattttttttaaaggaatttgtgagttcgaattt

SEQ ID NO: 69 - DNA, 5001 bp, Artificial Sequence
  Chemically treated genomic DNA (Homo sapiens)
aagtttaaaagataattgttttagtatttaatttaaaaaatataaattagttagatatagtggtgtgtatttgtagtcggagttatttaggagattgagataagaggattatttgagtttaagggtttgagattagtttgggtaatagcgagatttagtttaaaaaaagaaaaaaaaacgttaataataataaaaaaatttattcgtttattaaattatttgtaaggcgtttgaatgaaaggtgttttttttattgtggttttgtttagggtatttatagttgtaggtgagttaatttgtttggttttgttttttttaggtttgtttttttatgatttatttgtgtgagaaaattatttttacgttgtttttttggaggaagtttaatggatttaattagttgatgtcgttgtagtagtttgtgtacgacgtgtaggattagttgaattttttggttagcgaggaggattttaggcgtattgtttagtagttttatagtataggcgaggtgagtttttgggagtttaggtagggggtcgtgagaggtgttagggatttagtttgttttaaattttagtttttggaagtggtgtgagtttggggaagtagtgtggaaatggtttagttaatttataatatttttatacgtgtgataaatatagttttaagtgacgttttgaattgtagttttcggtttattttaggagttgttattttgttttgtcgtgttttgtttttatttttagagtttgttagtttgggagtgtagtgtttattgttttgggtgattgggtttttttttattttttttgggtattaggaatttaatttgttatttttggtagtttttaggatggtttttttgtattagcgtggagttattagttttatatagattttttgggtgggaaaatagttgagaaaaggtagtgaggtgtttttgtggaggtaatgtttggagatataaagatagagaattttggtgtatagatatatagagtaattataattaaagatgtatattaaaaaattttagtaagtaatgtttagtagaaatgattgagaatgggaggttttgttttggttttgtgatattgagtattagggcgcggtttggaaattttgttttaatggtattatatgtttgttttaggaacgggggtagtgttttcgtgtttttttattatgtgaaattgggagtttatatgaattagtgtgggttaagaagagcggttttgaatattgtaattaaaagtagttttgagattattaaaagttagatgtttatttttttaattttaggtgttaggtttggttttatagttagtttgtatgagttatataaattttttgaaattaaatttgaatttataagttagtgattttgaaaattggagtcgtcgggtagtaattttattagtttttaaatttttagttaaatggttagagaatttgttaatttatttaggaatattttaaagtgattgaatttaaggaagaatataggtgaaggattatattttagatgataagatattgttggatgtaaaaaatgtgttaattttaattttaaatttttttggtataggagttttttgttttttagtagtagattagtaattttttagattatattatatagttttttttatttgttattatatttttgtttgtttttgagagtttagtaagtaaatgaagatgtaaagaaggagggtaattaggtagtaggaattatattgtgtggttcgattttgattggtttcgggttttttttagatttgtttttcgtatttaatttgtagatttttagaattttttagtggtttttttgattttgttttttggtttagggttttatattacgtttagttgattgttttagttttttgtttttttttattatgggatagtttcgttttttttgagtttgaggcgatgagtagtgtttaggattaaattgtaaatggtattttagtaaatgttgtattaggaattagattaatattggttttgttttttagaatttttaatttaggtttaattttgaatagatttttagatagggggtattttttaggtttaagttagattgtggtaggaaattattgtgtggtttcggtggggttagagtttttaagtgagggagtttagggcgatggttattttttaagaaaggaagtagaatttttttataaagggaaagttttttttgttttttgttattttttttttttttttttttatttttttaagaaataaatataattaaaaagttaaagtttttttgggttattatttttggttttatttttttttttttttttcggaggttaattattattatggtagtatatttttttaggttttttttatgtgtgtgtgttaaatatttatataatggtataataatagaatgttttgatttttttttgaaaatgtttttaagtttttagagaagttgtaaggatagtattatgaatttttatataggttatatttatttatttttttaattaattaattaatttttttttttttttttttgagatagagttttattttgttgttaaggttggagtgtagtggtataatttcggtttattgtagttttcgttttttgggtttaagtgattttgttttagtttatagatataagttattatatttaattaaattttgtatttttagaagagatagggttttattatgttggttaggttggttttaaatttttgattttaagtgatttattcgtttcggttttttaaagtgttgggattataggtatgagttacggtgtttagtttattatatttaagttgattagttgttgatattttgttatatttgttcgattttttttttttttatttatttatttatttattttgtagatatgatgatattttttttttaaataatttagtttatattttttaaggagaaggatatttttttatataatttaatataattgatgattttagaaatataatattaatatagtattatgattgaatatattatttttatataagggtttgttattggttttaataattttttttaaagttatttttatttatgtatttattttgggatttagaatttagtttaaaattatttattgtatttggttgttattttttatttttttttttttttttatttcgttggtttttttgaagattttaggggagttgttttttagaatttttattttgatatttttaagttgtttttttttattcggtgtttggtttttgagacgtatttacgtggaatggttttgggttattttttagagtatttgtttagtttttgttgtcggtattaggttttttagtgttttaagtggttggtgtatttggttagggttttgtttttaagcgtgattttttgttgttttttcgtagattaatattatgtaaagtgaaatagtttaggacgtgttgtttttggattttcgttggttttgtataaacgttttggggaagttgttgttcgtggagattttacgggcgttgtattattatcggggtcgttatatcgtggaggatatttagcgtttggtgttcgatagcgacgtggaggagttgttgtagattttcgatgttatggatatttgcgttcgggatttgagtagcgggattatggtggacgttttagttttgattaagatagataatttgtatcgtttttgggttgatgaggaggacgaggtgatggtgtatggtggcgtgcgtatcgtgttcgtggaatattttattttttttttatgtggtattttttataaggtttaggtgaatttgtgtcggtggatttattagtaaagtatagagggcgacgcggatattcgtttgtgggtgaatggttgtaagttggttaatcgtggggtcgagttgttggtgttgttggttaattacggttagggtattgaggtttaggttcgcggtttggagacggagaagattaagtgttgtttgttgttggattcggtgtgtagtattattgagaacgttatggttattacgttgttagggtttttgatcgtgaagtattatttgagtttttagtagttgcgggagtattatgagttcgttatgatttattagttacgggatttttttcgggtatagattttgaaggaaattttattgattaatattatgggggggtataaggaaagttttagtagtattatgtgtttcgggtgttacgacgtttatttataggttagtttcggtatggatatttatgtattagatttgaatttttttattcggaggaaattgagtcgtttgttggattcgttcgattttttggggaaggattggtgttttttcgttatgaatttaggtttttttgatttcgtggtaaagtataatattagtaacggggtttttaaggattttttttttagttttttttacgttttgttgcgggaatggattatttattttgagagtatagtgggtatttttatgtttaaattgagggagttgggtcgtcgggatgtcgtagattttttgttgaaggtattttttgtgtttaaaattaatttggatggtaatggttaggaggtttatgtttcgagttgtaatagcggtattttttataattttattagttttgttgtatttcggtgagggtagtttttggtttgggtagggtttgtttggattgtagaagtaagggggtgatgtagtttatttttttttttggagatgttgagggtgtttttttttgtatttatagttagggggatgttattttttttttcggtttgatttgtttttttgtcgttattttttttttcgttttatttcgttgtttgtggatggttattgtagtttaagagtagaatagattttttattttggtcgtttgaaaagttagtgtatttttttttagtgttttggattttattttttattttttagtattttgttttttattgataattttgttggaatttttaattttttaatgatattt

SEQ ID NO: 70 - DNA, 5001 bp, Artificial Sequence
  Chemically treated genomic DNA (Homo sapiens)
aaatgttattgaaaagttaggaattttagtaaaattattagtaagaagtaaggtattggaggatgagagatggagtttaaaatattgagaggaggtatattagttttttaagcggttaaagtaaaagatttgttttgtttttaaattgtaatgattatttatagataacggaatgagacggggagggaggtagcggtagagaaataggttaagtcggagggaggagtggtatttttttggttgtgggtgtaggaagaaatatttttagtatttttaaagggaaggatgggttatattatttttttgtttttgtagtttaaatagattttgtttaagttagaggttgtttttatcgggatataatagagttaatggaattgtaagaggtgtcgttgttgtagttcgaggtataggttttttggttattgttatttaggttgattttgaatatagaggatgtttttagtaaaaagtttgcggtatttcggcgatttagtttttttagtttggatatgagggtgtttattgtgtttttagggtaggtggtttattttcgtagtagggcgtggagggggttggggaggaaatttttgggagtttcgttattggtgttgtattttgttacgaggttagggaggtttaagtttatggcgagaaggtattagtttttttttagggggtcgggcgggtttagtaggcgatttagtttttttcgagtgaggaggtttaggtttgatgtatggatgtttatgtcgaggttggtttgtgagtagacgtcgtgatattcgaagtatatgatgttgttgaagttttttttgtatttttttatggtgttggttagtgaggttttttttagagtttgtgttcggaagaagtttcgtggttggtagattatgacgggtttatggtgttttcgtagttgttgggggtttaggtaatgttttacggttaggagttttggtagcgtggtggttatgacgtttttaatggtgttgtatatcgagtttagtagtaggtagtatttgatttttttcgtttttaggtcgcggatttggattttaatgttttggtcgtggttgattagtagtattagtagttcggttttacggttggttagtttgtagttatttatttataggcggatgttcgcgtcgttttttgtgttttgttggtggatttatcggtataggtttatttggattttgtgaaagatgttatatgggaagggggtgaggtgttttacgggtacgatgcgtacgttattatatattattatttcgttttttttattagtttaggagcggtgtaggttgtttgttttgattagggttgggacgtttattatggtttcgttgtttaggtttcgggcgtagatgtttatggtatcgaggatttgtagtagtttttttacgtcgttgtcgggtattaggcgttggatgttttttacggtgtagcggtttcggtagtggtgtagcgttcgtggggtttttacggatagtaatttttttaggacgtttgtgtagagttagcgggggtttaggagtagtacgttttgaattgttttattttgtatgatgttgatttgcggggggataatagaaagttacgtttagggatagagttttggttaggtgtattagttatttagagtattaaagggtttgatgtcggtaatagaggttgagtagatgttttaaggagtgatttaaggttattttacgtggatgcgttttaaaaattaaatatcgagtggagaaaagtagtttgaaaatgttagaatagagattttgaaaaataatttttttgaagtttttaaaaaggttagcgaaatgaaagaagaaaaaaaaatgggagatggtaattaaatgtaatgagtgattttagattggattttgaattttaaaataagtatataaataaaaatagttttaaaagaaattattgggattagtggtaaatttttgtatgaggatgatatatttaattatagtattatattaatgttatgtttttggaattattaattatattgggttatgtgggaaaatatttttttttttaggagatataggttaaattatttagggaagaaatgttattatgtttgtaaaataaataagtaaataaatagaaaggaaaggaatcgagtaaatgtagtaaaatgttaataattgattagtttaaatgtagtaggttgggtatcgtgatttatgtttgtaattttagtattttgggaggtcgaggcgggtggattatttgaggttaggagtttgagattagtttggttaatatggtaaaattttgttttttttaaaaatataaaatttagttgggtgtgatggtttgtgtttgtaggttgaggtagaattatttgaatttaggaggcggaggttgtagtgagtcgagattgtgttattgtattttagttttggtaatagagtgagattttattttaaaaaaaaaaaaaaaaaaattaattaattaattaaaaaaataaataaatgtagtttatatgagagtttatggtattatttttgtaatttttttaaaggtttgagaatatttttaaaaaagagttagaatattttattattatattattatgtgaatgtttaatatatatatatagaaaaggtttgaaaggatatgttgttatgataatagttggttttcgagaaggggagagaggagtgagattagagatgatggtttaaggggattttagttttttggttgtgtttattttttaaaaaaataaaaagaaaggaaaaaaaagtgataaaaaatagaaggaattttttttttatggaagagttttgtttttttttttggagagtggttatcgttttggatttttttatttggaggttttgattttatcgggattatatagtaattttttgttatagtttggtttaaatttaaaagatgttttttgtttaagagtttatttagaattgaatttaggttgaaaattttggagggtagagttaatattgatttagtttttgatatagtatttgttggaatattatttgtagtttggttttaaatattgtttatcgttttaggtttaggaaagacgaaattgttttatagtggaggagaatagggagttaagatagttagttaaacgtagtgtgggattttgggttagaaaatagagttagaagggttattggggagttttgaagatttgtaaattagatacggaaggtaggtttggaggaggttcggggttaattaaagtcgggttatataatgtagtttttgttgtttaattattttttttttttatatttttatttatttattaaatttttaagggtaagtagggatgtaatgataaataaaggagattatatgatatgatttagaaagttgttggtttattattagaaagtaagggatttttgtgttaaaggagtttagaattagaattgatatattttttatatttagtagtattttgttatttaagatgtggttttttatttgtgtttttttttggatttaattattttaaagtatttttggatgagttggtagattttttggttatttaattgggagtttaaaggttgatgaaattattgttcggcgattttagtttttaaggttattggtttgtggatttaggtttagttttaagaaatttgtatgatttatataaattggttatagggttagatttggtatttgagattggggaggtaagtatttggtttttaataattttagagttgtttttagttgtaatatttagaatcgttttttttggtttatattagtttatgtaggtttttaattttatatggtggagaaatacgaaggtattgttttcgtttttgggataggtatatgatgttattagaatagggtttttaaatcgcgttttggtgtttaatgttatagaattagagtaaagttttttatttttaattatttttgttgggtattgtttgttagagttttttaatgtgtatttttaattatgattattttgtgtatttgtgtattagagttttttgtttttgtatttttagatattgtttttataaggatattttattgtttttttttaattgtttttttatttaggagatttgtgtggagttgatgattttacgttgatataaagaagttattttgaaggttgttaggagtagtagattaagtttttggtgtttagggggagtgaagagagatttagttatttagggtagtgggtattgtatttttaaattaatagattttggaaataaaagtaaaatacgataagataaaatgatagtttttaaggtgagtcgagaattgtagtttagagcgttatttgaggttgtgtttgttatacgtgtggaaatgttgtaggttagttggattatttttatattgtttttttaggtttatattatttttaagagttggaatttgggataggttgagtttttggtattttttacggttttttgtttgggtttttaggggtttatttcgtttgtgttgtggagttgttgagtaatgcgtttgaggtttttttcgttggttagggggtttagttggttttgtacgtcgtatataaattgttgtagcgatattagttggttgggtttattgagttttttttaggaaggtagcgtggagatgatttttttatataggtgagttatgggaggatagatttagagggggtagggttagataggttaatttatttgtagttgtgggtgttttgagtagagttatagtggaaaggatattttttatttaggcgttttgtaggtgatttgatgaacgagtgggtttttttgttgttgttgacgtttttttttttttttttagattgggtttcgttattgtttaggttggttttaaatttttgggtttaagtaatttttttgttttagttttttgagtagtttcgattataagtatatattattgtgtttggttagtttgtgttttttgggttgagtattggggtagttgttttttagattt

SEQ ID NO: 71 - DNA, 3158 bp, Artificial Sequence
  Chemically treated genomic DNA (Homo sapiens)
tttcgttttcggattttacggttgtaaattgatttggcgcgcggggaggaggagagcgtaggcgagcgaattcgcgagagagggagagagcgagcgagtaatagcgagagcgagagcgagagagtcgggaggtagagggagtagtgatcgtttttcggagtcgggatttatgtttgttttcgggattagcgaaggggattttacggttgagtatgagttaggttgttaggagttaggtatttttacgtttgtagttttcgcgtcgtgttcggaatgcgagttggacgtagggtttttttaagtttttatcgagtcgaataaaaagcgttcgttcgtagtttttcgttaaagacggatattgattttaggattttatagaatggagtaagaatgagaggaaaaaggtcggtagaaaagtatgaattggaggtttgttgagtttttttattttttgtttatatggggtcgtattttagtgtagtttttttattaggaattagttgggatagattaatatgtttttaaggaatttgattggtttattttagatagggggtttttttattattttaggagttatttattttttgtggaaagatatcgttaaggatttataattagatataaaatatatagggagtttgttcgttggaaggtgaggaatatagttatcgagaggagagatttggttcgttatttagtgttttttatgtcggagttttaaaggagtattcgtttgtttggtaggagatttattatttagtagtttatcgatattattattaaaaagtacggtatttatttgtttattttagttatattgggaggggaggaggttttgattatgtatatggataaaagtcgtttcgataggaagttagggaatgttatttaaagtgttgaagttttgtattagttcgtattattttattttgttgatcgtgatggtattatgaggaggttttatgagatttagatattaattggagtaattaaggttatagagatacgtattgggtttttgggttgtaatagttatgataatttggattttgtgagtttcgtttttttgtaaagtacggagagtaaattgtatttttaaggtttttagataatttttttttagtatttgtaagagaagtttgtttagtcggttttgagttatattatgtgtaatggggagggggagtatttgtgttagaatagttagtgtcgttgttaatgtgtcgaggagttttcgtagtgtaattgttttattacggatatttagattatggagtatacgttggttaatatggttaagttttgggtcgaagtttataaggatttggagaatttagatgagtttaaattatttatgaagcgtttttttagtaattattttttgattatcggaagtatttattagtattggggtaatgattgggatttgtagaatcgttataagtttttgtagagtgttacggaggtatagagataaaagatttaacgtattgttcgtaagtttttcggttttagtgtacgttgtcgttataattttaattattagttgtttagagagaggataatttagtagtggtttgtaagggtttagttatttttttattgtaatgagaatgggttttggggaatttttttggagagttagcggagttgcgtgtgttacggtagtattacgttgtgttagcgttttattttttgcgtgataggcgggaataatagttgtattatgtgtagtttggttaatatttttttttgtggtttttgtaataagggttataagttgtatcgaggtcgttgtgaattatagaacgtggattcggagcggagcgagtagtttattagttttgagattgatttggatttttaggatttggagttgaagtatttgttgtagaagatggatttacgtttttacgtttatattatttttattagtaacgagattcgtttcgatattttttttgattttcggtggcgtaagcgtatgttttttatttttaagagtaataagaatcgtatggattttatttatatggtgatcggtatgtttatgcgtatttgttagatgcgtaatagtagtttggattttatgttttttgtttatgttaatttttttagcgggagttattcggagggttggaatatgtttttcggggaatttggttatttacgttgggagaagattcgtttttaaaatagttagtgttataattggatttttttgttgggtaatcggtggaaaatatttttcgagacggtttatatttatttacgtagtcggattcggttatttattttattgcgaaatgagattggttagggtttcgtggatttgtcggatttttttaagaggtagttttatattaagattttagacgtgtaggtgtttgggtatagtttgaggtttaacgtcgattttttgcgtagtgtagtgtagtaggttaattagttttatatatagggcggttagttttattttttttcgttagtgatgttttttttgttggatattcgggatcgaattaatcgtttggttttttttgtggtttcggggaaattttagttggatttgtttttttgtatgttgaaatatcgtttgaaattgattaatagcgagattattagggtgaattacgttttggatttgtataatacggagatttttaaatagtcggattagatgatagttaaattttgttaattcgggattttttgttatggattttttttgttgttgtatatatataatagaataaaatgaagtaaaataaaataaaaaaatttataaaaatttgtaaaatgtaattaatatttaaagaaaaggaggaaaatttttatttgttggaaatgaaaacgttttagtaattgtataaaagcgttgggtatgtttgttatttttatatttattttgttatgaagaagggttttagttttttgtggagtattgagggagttgttttttaggttttaggtgttgtattgggggagaagggagaaagtatatgtaatgaattgtaaagatttttgttgtgtaggtgttaagattaaatattaaaaagaaagagagatatatgtaatgtataattgatattgttattttttttttttggaggaaatggatatagataaagaagatattttttcggttaagattt

SEQ ID NO: 72 - DNA, 3158 bp, Artificial Sequence
  Chemically treated genomic DNA (Homo sapiens)
aaattttaatcgaagaaatattttttttatttatgtttattttttttaaaaaggaaaaatggtagtgttagttgtatattatatatatttttttttttttttagtgtttaattttagtatttgtatagtagagatttttataatttattgtatatgttttttttttttttttttaatatagtatttgaggtttaagaagtaatttttttaatgttttataaaaggttgagatttttttttatgatagagtgagtatagaaataataaatatgtttaacgtttttatatagttgttagaacgtttttatttttaataaatgaagatttttttttttttttttgaatattaattatattttataaatttttgtgggtttttttgttttgttttgttttattttgttttgttgtgtgtgtataataataggaaaagtttatggtaaggagtttcgggttagtagagtttggttgttatttggttcgattgtttgaggattttcgtgttgtataggtttaaggcgtggtttattttgatgatttcgttgttggttagttttaggcggtgttttagtatataggagaataagtttagttggggttttttcggggttataggaggggttaggcgattaattcggtttcgaatatttaataagaggagtattattgacgaagaggaatagaattggtcgttttgtgtgtaggattggttgatttgttgtattgtattgcgtaggaggtcggcgttgaattttaggttatatttaaatatttgtacgtttgagattttgatgtagaattgttttttggagggattcgataggtttacggggttttggttagttttatttcgtagtagggtaggtagtcgagttcgattacgtaggtagatgtggatcgtttcgaaaaatgttttttatcgattgtttagtaaaagagtttagttgtagtattggttgttttggagacggatttttttttagcgtgggtagttaaatttttcgaagggtatgttttagtttttcgaatggttttcgttaaaggggttgatatagataaagaatatggggtttaggttgttgttgcgtatttggtagatgcgtatggatatgtcgattattatgtggatgaagtttatgcggtttttgttgtttttgagagtgagggatatgcgtttgcgttatcgagggttaaagaaggtgtcgaggcggatttcgttgttgatgaaggtggtgtggacgtagaggcgtgagtttattttttgtagtaggtattttagttttaggttttggaagtttaggttagttttaaagttgatgaattgttcgtttcgtttcgagtttacgttttgtggtttatagcggtttcgatatagtttgtagtttttgttgtaggagttatagagggagatgttggttaggttgtatatggtgtagttgttgttttcgtttattacgtaggggatggggcgttggtatagcgtggtgttgtcgtggtatacgtagtttcgttggttttttaggaaggttttttaaaatttatttttattatagtagaggagtgattggatttttgtaagttattgttgaattgttttttttttaggtagttggtggttgggattgtggcgatagcgtatattgaggtcgaaaagtttgcgggtagtgcgttggattttttgtttttgtgttttcgtggtattttgtaggagtttgtagcggttttgtaggttttagttattgttttagtgttgatggatgttttcgatggttaggaagtggttgttggggaggcgttttataaatgatttaaatttatttgaattttttaggtttttataagtttcggtttaagatttggttatgttggttagcgtgtattttatgatttggatgttcgtgatggggtagttgtattgcggaaatttttcggtatattggtagcgatattggttgttttggtataggtattttttttttttattgtatatgatatagtttaaggtcgattggataaattttttttgtagatattgaggaaagattatttgaagattttgaaggtgtagtttgtttttcgtgttttgtagaaggacggaatttatagagtttagattgttataattgttatagtttagaggtttagtgcgtgtttttgtgattttgattgttttagttgatatttggattttatgaagtttttttatggtattattacggttaataaagtaggatgatgcgagttggtgtagagttttaatattttgagtggtattttttgattttttgtcgaggcgatttttgtttatatatatggttaaagttttttttttttttaatgtggttgagatgagtaggtgggtgtcgtattttttgatgatggtatcgatgaattgttgagtggtaggttttttgttaagtaggcggatgtttttttgaaatttcggtatgaggggtattggatggcggattagattttttttttcgatggttgtgttttttattttttaacgggtaaattttttgtatattttatatttggttgtaaatttttgacggtgtttttttataaaggataggtagtttttggagtggtggaaaggttttttgtttgaaatgagttaattaaattttttggagatatgttggtttgttttagttggtttttggtgggagggttgtattgagatacggttttatataaataggaagtagaggagtttaataaatttttagtttatgtttttttgtcggtttttttttttttatttttgttttattttgtggagttttggagttaatgttcgtttttggcggagagttgcgggcggacgttttttattcggttcggtgggaatttgggagagttttgcgtttagttcgtatttcgggtacggcgcggggattgtaggcgtgggggtatttggtttttagtagtttggtttatatttagtcgtaaagtttttttcgttggtttcgaggataggtatgaatttcggtttcggaaggcggttattattttttttgtttttcggttttttcgttttcgttttcgttgttgttcgttcgttttttttttttttcgcgggttcgttcgtttgcgtttttttttttttcgcgcgttagattagtttgtagtcgtggggttcgggagcgagg

SEQ ID NO: 73 - DNA, 3720 bp, Artificial Sequence
  Chemically treated genomic DNA (Homo sapiens)
tgtagttgtttattaaaattttatatatattttggtatataattatattcgttggaatttattttatagatatatttatatttatatagttaaggatgttgattttaataatattggtataagtaaaaagttggaaattgtttatatgtttatggataggggataaatcgattaatttaaggtttttttttataatggagtattatatagttttgaaaaagaatgataagatttttatgttaggatatggtataatttttaagttattttaagtgaaaaaataataataataataatattgtagaataatgtgtatggttggatatatataaatttttttgaaagaatatttaagaaatttaaatgtggttattttaggagttaggaatgaggtaggtggagaggagggatttttattttttaatttagaatatattttgttgtgttagttgattttttttttattgttaataagtattatagttttttttaatttaaattattttttttagtataaatttaaaaaaaaaaaatttaaaatggaaaaatatataggcgtgagtaaaagaaatgaatggtaataatttttgtggtttattgagtgcgtttggatatttatgtgtttttagtttttttttataggaaatgtataggtgagaaattgacgttaagggggattgagtgttaagttagttagtggtagagggtagatttaaatttaatacggtttttttttgttgtttttcggtttttgtttttaggtgggaagcgtatttatcggacggtcggttcggtgaggcgtagcgttttagattggcgtattcgcggttttagcgttttacgtttggggagcgcgcgcgtacgtagcggcgcgagtttggcggcggcggcgataataataacgttatagttcgagttttttttttcggagttttcggtatatattttgtgtttatgtttgggtatttacgttacggcggtagggtcggggttttttaaaatggtagtggttcggggagtcggaagttcggagttagcgtcgtcgtagttatataagtgggggggttgtgggttgggggagttcggtagcgttttggagaggcgaggagtcgtcgttcgaggtcggtgcgggcgagcgagggcgtcgcggtttttcgattttttttttagaggtgagtgttcgaagttaggagttcggcgtttataggtttgtgcgttgcggggaatttttatcgttagttttttcgttattcgcgcgtttttaagtttagcgggcgaggtttcgggcgttttatagtcggcgtcgcgttatgttttattttagcgagtttttcgaattcgacgcgtttttcgttaagtttattgaaggttgttgcgtcgaatttagcgttgaattgtttcggttgtttgttagggacgttttcgcggttatcggttattttggaggtaaggagggcgagtaggggtgtttagacgacgacggcgtagcgcgggggcgtattatatttgagaattaggagggattgggatattggagttatgagaataggggcgatgggaagtttaggagttttggggtgcgtatttttatttttatttatattgggtcgttagcgttttcgtaggaatttgtgcggttatcggagcgtttttttgtttgtgtacgtgtgttttgcgtgtgtatgtttttatgtgttttttgggacgtatgcgggtttttgttgaattagaatgtgtaaaaggtattttgtgtatattcgtgggtattaagagttttgtaggtaggggttgtggatttaggtgtattttttgatgtgtttagagttgatttttgttttttttttagtaggcgattttttgagttgggttttgaatagttgcggcgtaagtggggatttagtcgatttttgttttttggaggggtttgcgtttatattttttttcggttttagttatagcggtagtttttttatttaggtagtgttcgaatattcgtacgattcggaggtattttttaattttatgtcgggcgttttaggtttggtattttttttcggtttagaggtagtagcgtttagattttcgttggatgtttttttttttgcggggttcgatgttttgttgtcgggttcgtcggatttttatttttcggatttgggcgttgttttttttttagaggcgttttgggaggtttcgttttgcgcgggtgttttttcgtagtgtttgtatgagttttagtttttttcgttcgacgttaagttcggttttcggcggtttttcgtttcgttagcgttggacgttgtttttgtttttaagggtttttacgcgttttgggagttgttttttgtgggggttttagggaattgtgggttatagggagattattaggtcgtttcggaggttcgttttttcgtaatagggattaagattgaggatttgttgtttattagttgttttgcggaattgtcggtcgttttagttaatagattttattttagcggggtttatgacgttttttcgttggtttcgggtgatttaggggagggggttgagggtttttttgggtttttgattttttttagtggggagggagggagtagcggcgacggcggagagtttttggttagtacgtagttttagtttttttcgttgggttttcgtagcgtcgtcgcggcggatttttttaaatttttggtggcggatatttttggaagtagtggcgtggttgtattattcgtgtcgtcgtcgtcgtttattttttttttttaggttaaggcgcgacgtaaggggcgtcgcggcggtaaatgtagtacgcgttgtttttgttcgcggtcgtacgttaaggttttcgtttgttcggtggagagttgtgtgcggagttttgcgcgtttcgacgagtttaatcgttatttgcgtatttatacgggttataaatttttttagtgtcgtatttgttttcgtaattttagtcgtagcgattattttattagttacgtgcgtatttatatcggcgagaagttttttgtttgcgacgtgtgcggtcgtcgtttcgcgcgtagcgatgagaagaaacggtatagtaaggtgtattttaagtagaaggcgcgcgtcgaggagcggtttaagggtttcggtttttattcgttgggtttttttttcgtttttttttgagtaagagatgggtttatgggttggggcgtcgtcgttcggcgcgtacgagtttcgggtcgttttttttttcgttttttttttaattttttttcgtacgttcgagggtcggttttcgtttcgtttttagtttttttgaagcgttcgtcgtatacgttttatttagtattagttcgtcggatagttttcgcggtttaggcgttgttatttttgttagtcgcgttttgggggaagttttttgagattatttagtgaataggtattattttgggatttaagatagttttttgtaattgtatacgttttacgtttttttttataatttttagagataggttggggtaggttaaggcggtttcgcgcgggattttgtatagtagtgttttatttagtagtcgattggatgtaacgttttgttttgggttttttttttttttgttgttgttaatttttgtaaagtagacgttatttttaagtagttgataaaattgtttatttttgtaattaaaattattgtgttaaaagtttattgaatttgttatgtaagttttt

SEQ ID NO: 74 - DNA, 3720 bp, Artificial Sequence
  Chemically treated genomic DNA (Homo sapiens)
aggagtttatatggtagatttagtaagtttttagtataataattttaattgtaaaaataaatagttttgttaattgtttgagagtagcgtttgttttataaaaattaataataataaaaggaaaaaaaatttaaagtaaaacgttatatttaatcggttgttggataagatattgttgtataaagtttcgcgcgagatcgttttggtttgttttagtttgtttttgggggttatagaggaaggcgtggggcgtgtgtagttataaaagattgttttgaattttagggtagtgtttatttattgggtggttttagaagattttttttaaagcgcggttgataagggtgatagcgtttggatcgcgggaattgttcggcgagttggtgttgaatagggcgtgtgcggcgggcgttttaaggaaattggaagcgggacggaggtcggttttcgggcgtgcgaggaggagttggaagaagagcggggaggggaacggttcggaattcgtgcgcgtcgaacggcggcgttttaatttataaatttattttttgtttagagagaagcgaaggagaggtttagcgagtaaaagtcgaggtttttgagtcgtttttcggcgcgcgttttttgtttgaggtgtattttgttgtgtcgtttttttttatcgttgcgcgcgaagcggcggtcgtatacgtcgtaagtaaaaggtttttcgtcggtgtgggtgcgtacgtggttggtgaggtggtcgttgcggttgaagttgcggaggtagatgcggtattggaagggtttgtggttcgtgtggatgcgtaggtggcgattgagttcgtcggagcgcgtaaagtttcgtatataattttttatcgggtaagcgaaggttttggcgtgcggtcgcgggtagaagtagcgcgtgttgtatttgtcgtcgcggcgttttttgcgtcgcgttttggtttgggggaaaggggtgggcggcggcggcggtacgggtggtgtagttacgttattgtttttagggatgttcgttattagaggtttagggaagttcgtcgcggcggcgttgcgaaggtttagcggggaaagttgaggttgcgtattggttagaaatttttcgtcgtcgtcgttattttttttttttttattaggaggggttaggagtttagggaggtttttagtttttttttttaagttattcggggttagcgggaaagcgttataggtttcgttgggatagagtttgttggttgggacggtcggtagtttcgtagggtagttgatggatagtaagtttttaattttggtttttattacgggaaaacgagttttcggggcggtttggtagtttttttgtgatttatagttttttggggtttttatagaaagtagtttttagggcgcgtagggatttttgaaggtagagatagcgtttagcgttggcgaggcgggaggtcgtcggaggtcgggtttgacgtcgggcggggagagttgaggtttatataggtattgcgagggggtattcgcgtaaggcgaggttttttagaacgtttttgggaaaggggtagcgtttagattcggggagtaaaggttcggcggattcggtagtaaggtatcggatttcgtaggaaaaggggtatttagcggggatttggacgttgttgtttttggatcggggaagggtgttaggtttaagacgttcgatatgaggttgaagagtgttttcgggtcgtgcgggtgttcgggtattgtttgaatgaagaagttatcgttgtagttgaggtcgggagggggtgtgggcgtaggtttttttaggaagtaggagtcggttaagtttttatttgcgtcgtagttgtttaaagtttagtttaagaagtcgtttgttgaggagggagtaggaattagttttgggtatattaaagggtgtatttgagtttatagtttttatttataaaatttttggtgtttacggatatatataaagtgttttttgtatattttgatttagtaggggttcgtatacgttttaaggagtatatagaaatatgtatacgtaaaatatacgtgtataggtaaaagggcgtttcgataatcgtataggtttttgcggaggcgttggcggtttagtgtgggtgggaatgggggtgcgtattttaggatttttaagttttttatcgtttttatttttatagttttaatgttttagttttttttggtttttaggtatggtgcgttttcgcgttgcgtcgtcgtcgtttgagtatttttgttcgttttttttatttttagggtagtcggtggtcgcgggagcgtttttggtaggtagtcggggtaatttagcgttgggttcggcgtaatagtttttagtggatttgacgaggagcgcgtcgggttcggaaaattcgttaaggtggagtatggcgcggcgtcggttgtggggcgttcggggtttcgttcgttgggtttgggggcgcgcgggtggcggggaggttggcggtaggggtttttcgtagcgtatagatttatgggcgtcgggtttttggtttcgggtatttatttttgggaaaggagtcggggagtcgcggcgttttcgttcgttcgtatcggtttcgggcggcggtttttcgtttttttaaagcgttgtcgggtttttttagtttatagtttttttatttatatagttgcggcggcgttggtttcgggttttcgatttttcgggttattgttattttgggaggtttcggttttgtcgtcgtgacgtaaatgtttaaatatggatataggatgtgtgtcggggatttcgaaaaggaaagttcgagttgtgacgttgttgttgtcgtcgtcgtcgttaggttcgcgtcgttgcgtgcgcgcgcgttttttaggcgtggagcgttggggtcgcggatgcgttagtttggggcgttgcgttttatcgggtcgatcgttcggtagatgcgttttttatttggaggtagaggtcgaggggtagtaggggaggatcgtgttgggtttgaatttgttttttgttattaattagtttgatatttagttttttttaacgttagttttttatttgtgtattttttgtggagagaaattgagagtatataaatgtttaggcgtatttagtaaattatagagattattgttatttattttttttgtttacgtttgtgtgtttttttattttaagttttttttttttaaatttgtgttaggaaaaataatttaaattaaaaaggattgtaatatttgttaatagtaggaggaaagttaattagtataatagggtatattttaaattgaaaagtaaaagttttttttttttatttattttatttttagtttttgaggtagttatatttaagttttttgggtatttttttagaagaatttatgtatatttaattatatatattgttttgtaatattattattattattatttttttatttgaaataatttagagattgtgttatgttttgatataaagattttgttatttttttttaaggttgtatagtattttattgtaagggaggattttgagttagtcgatttattttttatttatgagtatgtaggtagtttttaattttttatttatattaatgttgttggagttaatatttttgattatataaatgtgaatgtgtttgtgagataaattttaacgagtgtaattgtgtgttaaagtatatgtaaaattttgatagataattgta

SEQ ID NO: 75 - DNA, 4001 bp, Artificial Sequence
  Chemically treated genomic DNA (Homo sapiens)
ggtttattgtaatttttgtttttcgggtttaagtaatttttttgttttagtttttttagtagttgggattacgggtgtttgatattatatttggttaatttttgtatttttagttgaggcgggttttattatgttggttaggttggttttgaattgttgattttgtgattcgttcgtttcggttttttaaagtgttgggattataggtgtgagttacggtatttggttttcgttgattttttggggggtaggttttaattttatttaggagtgtttttgtttttaggattttgttttttaggaattttaatttttaattttttagagtaaagatagtatgaggtaggattagttatagggagcgttagataagtgtttgttgagtgaatgaatgaatgagtggatgaatgaagtttagttacgagttttcgaataaaagggattagttgaggttatggaatttatttttttgtttagagttggttatagttttttatgtttttttggattttggtggttaggatttgattttagttttgaggttttttttaggtgggtttttttttttttattagtttgtagttttagttgttttttttgtttatagtagaaaagttaatattttttttggtttttatgaatattatagtaaaatgatttgtgtttttaaagtttagtttttttagatttataatgttatagtttatttaagtgatattgggatttttcgattataaatatttggtgtattaggtttgatattagattagggtttgggtttagggtttttagttgagaattttagtttagttgtttattgagtgattttgagtaagtttttagatttttagggtagaagttaaatcggatttatttttatgttttgtagtatttgtaatttggtgaatatttattgatttaaatttggttgtaatagtttttatttttttagaggaggtatatgagagttaaatgaggtaatgaattgcgtagttatttgtaaatatgacgaggttttgtaaatagaattgggataatataaatattcgttagaataatttttttattttttgaaagagtatatattttttattttatttcggttttttttttagggggaggatgggtggttaaatataagatggagatgttattttagaggggttttttataggtggagggtagggaaggaatttttttttagattattttattatttaaggataggtataattattttgggttttattttagtttttttagtcgtagttttatattggttttttacgttgatattttagttgttttttttatttatagttttgtgtgttaacgtggtttttgtttttttttgttcgtagttttttgttatgttggtagggtttaaaaggaagataggtattggttggataggaagggagaggattttgaagttaagagggaattttagggtttttagtttagttttattttttatagtttagagaagtggatggaaaggttattcgtttgaataagaggagcgtttttttttttatttggttatttgtttgtttttaaggttttgtttaatttattattgttggttggaataagattttaattattttttaatgttttttttttagagtttaaaaattttttggatattattgggtagttgggagttttggataagttgttttatttttttgaatttttatttttttatttgtgtatttattttataggattgttatagagattaaatgaaagtatggataaaaatttagtatataggaagtatatcgtatattttttaaaagttaagataagataggtttatatagtaggaatatgggtaattttaaattacgagaaaattaaatatgttttgtgtttgattttggaatgttacgtattttttttttttatatttgatttttatttttttaattgttttttttttgataaataaaatgagtattttttttaagtatagtaaagagaggaggttgttggaagaattatattggaattaaaatatgaaggagttttgtaagattaaaaggatgtatttgttgtaatttgtaaaatttatatttttaagaaaggattttagaaaaattttgatttttttggggttttttttaggttttttttttttttatatttttgttttagattttattttttgggtaaaatttgggtgttggaggtagttgggtggtatattttttttttgaaacggagttttatattgttatttaggttggagagtatttgtaattatagtttattgtaagttttaattttttgggtttaggtgatttttttgttttagttttcggagtagttgggattataggtacgtgtaattatatttaattaatttttgtattttttgtatagagttttgttttgttgtttaggttgtgtaatgattttttaattaatttttgtataatataattaatagtgtaggttgaggggtgaggatatgaggaggttttatttagagaatttagtttttaaatttagttttgtagtaattgttattttttgattaatttttagtttaaggtgaggaagggtagtagtttagtttgatagtttagtatggttttattttttttattagaagatgagaggtgaagatgtttgtttgggaaatagggagggtaaggatgtattttttggaagagaggaatttttttttttagtaagaaggcgtggttatagaaggttatttttttttgtttatggtagatttggtttagtattttaagggagtttttgtagaggatagagtttagtttgtgtttttaagttagtagagagattgttgtttggtaatataaagtttagatatataaatataaagattatataattgaggaatattttggcgtagatttgtagagataatacggttatgtatttatttatagagggtttttcgggtaatatatagttacgatgatatttattttttttttagattttttgatttatggagattatttacgatttttagaatatttttattttgttttttttgtagtttagtgatttagggagtagtgttttttattgttttaggtgtatttatttatatagcgatttcgaatgtatggttgggggtcgtattgtttggggttttattttgattttattatttattagttgttatttaatttttggattgttatttagtttagaatgttggtagaatttttattataggggtgttttaggattaaaggagaatgtatgtaaaatattataaatagtttttggtagagtatatttggtttaggttatatgttagtttttatgattaatgtatataggtggatagatgggttaggatatatattgtttttatttatttttttttacgtatagtattaaggaaaaggtagtagaataacgtagttttttttaggtttttatttggttttattttttagtttttttttttgggaatttttttattttatattttaagaaatttatttttatttttttatggtttacgcgttttaaaagttatagagtatagtttttaagttggttttaagaatttgtttaaagtaaacgtttttttcgtttttaatttagattttagtaagaggttatttttcgggttattttttttttttcggttttggttgggataggttgttatgttattttttattttattatatatatatatattcgatttcgttagaagtaggagtaattaaattaaaatcgtttgaaggggagcggggaggggttggaggaggggtagggtagaggatttttttaaggaatttagtttaggttagttcggaggcggaggttgttaattggaaaggttttgagaaagtttgagggggtttaagaaggggggaaacgcgcgcgcgcgttttacgtaatatattttttgcgggaaaattttttgaataattttagagaatttttttgataagttttcggagtttttcggagtttggaaagcgttagttttttgg

SEQ ID NO: 76 - DNA, 4001 bp, Artificial Sequence
  Chemically treated genomic DNA (Homo sapiens)
ttaagagattggcgttttttaggtttcgaggggtttcgggaatttgttaaagaagttttttgaaattgtttagaaagttttttcgtaaagggtgtattgcgtagagcgcgcgcgcgcgttttttttttttttgagtttttttaagtttttttaaagtttttttagttggtagttttcgttttcggattggtttgggttggattttttgggggggttttttgttttgttttttttttagttttttttcgtttttttttagacgattttggtttggttgtttttgtttttggcggggtcgggtgtgtgtgtgtgtggtggagtggagggtggtatagtaatttgttttaattagagtcggggaggaaagggtggttcggagggtggttttttgttggggtttgggttgggggcgggggagacgtttgttttgaatagatttttggggttagtttagggattgtgttttgtgatttttggagcgcgtggattatggaggggtgggggtgggttttttggggtgtaaagtgggagagtttttagagaaggaagttaagaaataaggttagatgggagtttagggagggttgcgttgttttgttgttttttttttggtgttgtgcgtggggaagggtgagtgggggtagtgtgtattttgatttatttgtttatttgtgtgtattaattataaaagttaatatatagtttgggttaggtatattttgttaggaattgtttgtggtgttttgtatgtatttttttttaattttaaaatatttttatagtggaagttttgttagtattttggattgagtagtagtttagaggttgagtagtagttagtaagtggtggggttaagatgggattttaggtagtgcgatttttaattatgtattcgaaatcgttatatggatgagtgtatttggagtaatgagggatattgttttttgagttattgggttgtaggggagataaaatgaaagtgttttgggagtcgtgggtggtttttataggttagagggtttggggagggagtgggtgttatcgtggttgtgtgttgttcgaggggttttttgtgagtgagtgtatggtcgtgttatttttgtaggtttacgttagggtgttttttagttgtgtggtttttgtatttgtgtgtttgggttttgtgttgttaaatagtagtttttttgttgatttggggatataggttgaattttgttttttgtaggaatttttttaaggtgttgggttagatttgttataaatagagggaggtagttttttatggttacgtttttttgttgaggaagaaggttttttttttttagggagtatatttttgttttttttgttttttagataagtatttttattttttattttttgatgagaagggtgaggttatattgagttgttaggttgagttgttgtttttttttattttgggttgggagttgattagggaatggtagttgttgtagagttggatttgagggttgggttttttggatggggtttttttatgtttttattttttaatttgtattattgattgtgttgtgtaggagttagttaaaaagttattgtatagtttgggtaataaggtaaaattttgtataaaaaatataaaaattagttggatgtgattatacgtgtttgtagttttagttatttcggaggttgaggtaggaggattatttgagtttaggaagttgaggtttgtagtgagttgtgattgtaaatgttttttagtttgggtgatagtgtgagatttcgttttagaaaaaaagtatattatttagttgtttttagtatttagattttatttaaggggtgaggtttggggtaggaatgtgggggaaggggaggtttagggggagttttagaggggttaggatttttttgaaatttttttttagaggtatgggttttataaattgtagtaaatatatttttttaattttgtagaatttttttatattttaattttagtatgatttttttaatagttttttttttttattatatttggggaaagtatttattttatttgttaagaaaaaaataattgaaaagatagggattaaatgtaaaaagaaaaaatacgtggtattttaaagttaaatataaagtatgtttaattttttcgtggtttgggattatttatatttttgttgtatgaatttgttttgttttaatttttaagaaatgtacggtgtattttttatatgttaggtttttatttatgtttttatttaatttttgtgatagttttgtgaagtaggtgtatagatgagaaaatggaagtttagagaaatgaagtaatttatttaaggtttttagttatttagtaatgtttagggaatttttggattttgaagaggaggtattaagaggtggttagagttttattttagttaataataatgggttgaataaagttttaggggtaggtaggtggttagatgggaggagaagcgttttttttgtttaggcgaatgatttttttatttatttttttaggttgtagaaagtggagttgagttgggggttttgaggtttttttttgattttagagttttttttttttttgtttagttaatgtttgttttttttttgggttttattagtatgatagggggttgcgggtaggaggggatagaggttacgttgatatatagggttgtgggtgagagagatagttgaagtgttagcgtgaggggttagtgtggggttgcggttgggagggttggggtggggtttagggtagttgtgtttgtttttgggtgatggaatgatttggaaagagattttttttttgttttttatttgtgagaagtttttttagagtgatatttttattttatgtttggttatttattttttttttgggaagagagtcgaggtggggtaagggatgtgtatttttttaaggagtgggagaattattttagcgaatgtttgtgttgttttagttttgtttataaagtttcgttatgtttatagatggttgcgtaatttattattttatttaatttttatgtattttttttgagggagtaagagttgttatagttaagtttaggttagtaaatatttattaagttgtaggtattgtagggtatagagatgaattcgatttagtttttgttttggaggtttgggaatttgtttaagattatttagtgagtagttgagttagggtttttaattaaagattttgggtttaggttttggtttgatgttaggtttgatatattaggtgtttgtggtcggggaattttagtgttatttgaatgggttgtgatattatgggtttgggagagttgagttttggggatataggttattttattgtagtatttatggaaattaagggaagtattggtttttttgttgtgagtaagaggagtagttggggttgtaagttggtggggaggagagaatttatttgagagaaattttaggattggggttaagttttgattattagagtttagagagatatgaaggattgtgattagttttgagtagagagatggattttatgattttaattggttttttttgttcggagattcgtgattggattttatttatttatttatttatttatttatttagtagatatttatttagcgttttttgtggttggttttgttttatattgtttttgttttggagaattggaggttggggtttttgaggggtagggttttggagataaggatatttttgggtagaattaggatttattttttaggaaattaacggggattaggtgtcgtggtttatatttgtaattttagtattttgggaggtcgagacgggcggattataaggttagtagtttaggattagtttggttaatatggtgaaattcgttttaattaaaaatataaaaattagttaggtgtggtgttaggtattcgtaattttagttattgaggaggttgaggtaggagaattgtttgaattcgggaggtagaggttgtagtgagtt

SEQ ID NO: 77 - DNA, 4858 bp, Artificial Sequence
  Chemically treated genomic DNA (Homo sapiens)
ggaatttttttttttttttttttttttgaaatagggtttcgttttgttatttaggttaaagtgtagtgtcgcgattttagtttattataatttttgttttttaggtttaagggatttttttattttagttttttaagtagttgggattataggtatgtgttattatattcggttaatttttgttttttttatagagatagggttttattatgttgtataagtcggttttgaatttttgagtttaagtgagttatttgttttggttttttaaagtgttgggattatatatgtgaattatcgtattcggttttaaaaatgtttttttaagcgtaattacgtaatgttagttgtagtttagatttttggatgttaatttaaaatagttttataggaatttagtgtggtggtttacgtttgtaattttagtttgaggtaggtggattatttgaggttaggagttcgagattagttgggttaatatggtgaaattttgtttttattaaaaatataaaaaaattagttgggtatagtggtaggtattcgtaattttagtttttcgggacgttgaggtagaagaattgtttgaatttaggaggtagtggttgtagtgagtttagatcgtgttattgtattttagtttgggtaataagagtaaaattttgttttaaaaaaattaattaatttaggttgggcgtagtggtttatgtttgtaaattttagtattttgagaggttgaagcgggtggattatgaggttaagagatcgagattattttggttaatacggtgaaattttatttttattaaaaatataaaaaaaaaattttaaaaaataaaaaaataaaaataaataaataaattaaaaaaatataataattagttaggcgtagtggtaggcgtttgtaattttagttagtcgggaggttgaggtaggaggagaatggagtgaatttaggaggtagagtttgtagtgagttgagatcgcgttatagtattttagtttgggtaatagagcgagattttattttaggaaaaaaaaaattaattaattaaaaaaatagtaagataaataatattttttttattttagtaaaaggatgaagttagttttttaatgaataaaaataagagattgttgaatgttaagttttatagatagtttagataatatagggagatattatttttatatatatatatatatatatatatatatatatatatatatatatatatatatatataaaatagttgcgtatggtggtatgggtttgtagttttagttattggggtagggttagggggtgggaggttgaggggagaggatgttttaatagggaggttgaggttgtagagagttatgattacgttattgtattttagtttgggtgatatagtaagattttgttttagaaaaaaaaaaaagaaaaaagttaagaatgtatttttgaggaattttattaataaaatgtattaaatatagttaaagagttttttgttatatgttaagtggaaagttatgaagaaagagaagaatagaagtaggaggatattggtttttattttttatttttttaagaagtaagatttattattttttaaaaagtttaaatattggtaaggtaagatataatttttatttataatattgtatttttgtttttaggtaataaattaaatgttagataaaagtataatatttattatttaatttttaggttttagtatagaatttataaatattttgttggttaaggtaaaaaggtgtattgtatttttagagagtttgtagagttttgagtattaattttataatttttatattttaatttatataaagtattattaggttaagaaatagattatatagtaggtataatatttttgggtatgtaaatatgttaaggattaaagtaagaaaagagtaattataggggttatattatatttgttaaaaagtgatttgtttaaaaattaaaaagaagtcgggtgtagtggtttatatttgtaattttagtattttgagaggttggggtgggtggattatttgaggttagtagtttaaaattagtttggttaatatagtgaaattttatttttattaaaaatataaaattaggcgtggtggtaggcgtttgtaattttagttattagggatgttgaggtaggagaatcgtttgaattcggaaggtagaggttgtagtgagttaaaatcgtattattgtattttagtttgggtaataagagtaaaattttgttttaaaaaaaaaaaaataaaaataaaaataaaaaagaaatttagtttatttttttgtgtaatttttaataaattgttgagaagtgattttatataggaattttgtataatttattttgatgcgttcgaggtggtcgttagttgatttcgcggagtttatttttttggttttttcgttttaacgtcgttcgttttttagttaggatgtttgttcgtggttcggttatcggtatcgatttgggtattatttattcgtgcgtcggggttttttaatatggtaaggtggagattatcgttaacgattagggtaatcgtattatttttagttacgtggtttttacggatatcgagcgttttatcggcgacgtcgttaagaattaggtggttatgaattttattaatattattttcgacgttaagaggttgattggacggaaattcgaggatgttatagtgtagtcggatatgaaatattggtcgtttcgggtggtgagcgagggaggtaagtttaaagtgtaagtagagtataagggggagattaagattttttttttagaggagatattttttatggtttttacgaagatgaaggagatcgcggaagtttatttggggggtaaggtgtatagcgcggttataacggtttcggtttattttaacgattcgtagcgttaggttattaaggacgtaggtattattacggggtttaatgtgttgcgtattattaacgagtttacggcggcggttatcgtttacggtttggataagaagggttgcgcgggcggcgagaagaacgtgtttatttttgatttgggcggtggtattttcgacgtgtttattttgattatcgaggatggtattttcgaggtgaagtttacggtcggcgatatttatttgggcggtgaggatttcgataatcgtatggtgagttatttggcggaggagtttaagcgtaagtataagaaggatattgggtttaataagcgcgtcgtgaggcggtcgcgtatcgtttgcgagcgcgttaagcgtattttgagttcgtttacgtaggcgagtatcgagatcgattcgttttacgagggcgtggatttttatacgtttattacgcgcgttcgtttcgaggagtttaatgtcgatttttttcgcgggattttggagtcggtggagaaggcgttgcgcgacgttaagttggataagggttagatttaggagatcgtgttggtgggcggttttattcgtatttttaagatttagaagttgttgtaggatttttttaacggtaaggagttgaataagagtattaatttcgacgaggcggtggtttatggcgtcgcggtgtaggcggttatttttatcggcgataaattagagaatgtgtaggatttgttgttattcgacgtgatttcgttgtcgttgggtatcgagatagttggcggtgttatgattttatttattaagaggaatattacgatttttattaagtagacgtagatttttattatttattcggataattagagtagcgtattggtgtaggtatacgagggcgaacgggttatgattaaggataataatttgttgggtaagttcgatttgatcgggattttttttgcgtttcgcggggttttttaaatcgaggttattttcgatattgacgttaatggtatttttaacgttatcgtcgtcgataagagtatcggtaaggaaaataaaattattattattaatgataaaggtcgtttgagtaaggacgatattgatcggatggtgtaggaggcggagcggtataaatcggaagatgaggcgaatcgcgatcgagtcgcggttaaaaacgttttggagttttatatttataatattaagtagacggtggaagacgagaaattgaggggtaagattagcgagtaggataaaaataagattttcgataagtgttaggaggtgattaattggttcgatcgaaattagatggtagagaaagatgagtatgaatataagtagaaagagttcgaaagagtttgtaattttattattagtaaattttattaaggtggttttggcggcggtagcggcggcggcggtttaggagttttcgggggatttattatcgaagaagtggattaagtttgtatttaagttagcgtaaatttttttgtttttttttttttttttttttttttgtttgtttttttgaaatgtttttgtgttaagtacgagatttattgttggaagtttttggtatatgtaaatgaaaggagaggtgtaataatttagtttaattataaaagttttaaagtttgttttttaaaaatattattcgaggtttttttttaatgtattttgcgtgtttgttgatttgagtatttttgattagttcgtgtatggagatttgtttgagatgagaaattttaagtttgtatatttgttttgtagaagtttggaaatagtaaaatatataggagtttaaattgtttatttttatgtattattttaaaattaaattgaatattgtagtaatgttaaggataggtatattttttgtaaataaatgtataaaatgtaaatgtaaagtaaagttgaaattgattttaaaaaaaaaaaa

SEQ ID NO: 78 - DNA, 4858 bp, Artificial Sequence
  Chemically treated genomic DNA (Homo sapiens)
ttttttttttttgagattaattttagttttattttatatttgtattttatgtatttgtttgtaaaaagtatatttgtttttaatattattgtaatgtttagtttagttttaaagtagtatataaaaataaataatttaagtttttatatattttattgtttttaagtttttatagaataggtgtgtaaatttaaggttttttattttaaataaatttttatgtacgaattaattaaaaatgtttaagttagtaaatacgtaaaatgtattaaagagaaatttcgaataatgtttttaaaaaataaattttggaatttttataattaaattaagttgttgtatttttttttttatttgtatatattaaagatttttaataatagatttcgtatttggtataaggatattttaaagaaataaataaaaaaaaagagagagagagaaaggtaaagaggtttacgttgatttgagtgtaagtttagtttattttttcgatggtgggtttttcggaggtttttgaatcgtcgtcgtcgttgtcgtcgttaggattattttggtaaagtttgttgatgatggggttgtaaattttttcgagttttttttgtttgtgtttatatttatttttttttgttatttggtttcggtcgagttagttgattattttttgatatttgtcgaggattttgtttttgttttgttcgttaattttgttttttagtttttcgttttttatcgtttgtttgatgttgtaggtataggattttagggcgtttttggtcgcgattcggtcgcgattcgttttatttttcgatttgtatcgtttcgttttttgtattattcggttaatgtcgtttttgtttagacgatttttgttattggtgatggtgattttgttttttttatcggtgtttttgtcggcggcggtaacgttaaggatgttattggcgttaatgtcgaaggtaatttcgatttgggggatttcgcgaggcgtagggggaatttcggttaggtcgaatttgtttagtaggttattgtttttggttatggttcgttcgttttcgtatatttgtattagtacgttgttttggttgttcgagtaggtggtgaaggtttgcgtttgtttggtggggatcgtggtgttttttttgatgagtggggttatgatatcgttagttgtttcgatgtttagcgataacggggttacgtcgagtagtagtaggttttgtatattttttgatttgtcgtcgatgaggatggtcgtttgtatcgcggcgttataggttatcgtttcgtcggggttgatgtttttgtttagttttttgtcgttgaagaaattttgtagtagtttttggattttggggatacgagtggagtcgtttattagtacgattttttggatttggtttttgtttagtttggcgtcgcgtagcgttttttttatcggttttagggtttcgcgaaagaggtcggtattgagtttttcgaagcgggcgcgcgtgatggacgtatagaagtttacgttttcgtagagcgagtcgatttcgatgttcgtttgcgtggacgagtttagggtgcgtttggcgcgttcgtaagcggtgcgcgatcgttttacggcgcgtttgttgggtttaatgttttttttgtgtttgcgtttgaattttttcgttaggtggtttattatgcggttgtcgaagtttttatcgtttaggtgggtgtcgtcggtcgtggattttatttcgaagatgttattttcgatggttaggatggatacgtcgaaagtgttatcgtttaggttaaagatgagtacgtttttttcgtcgttcgcgtagttttttttgtttaggtcgtaggcgatggtcgtcgtcgtgggttcgttgatgatgcgtagtatattgagtttcgtgatggtgtttgcgtttttggtggtttggcgttgcgagtcgttgaaataggtcgggatcgttatgatcgcgttgtgtattttgttttttaggtaggttttcgcgattttttttattttcgtgaggattatggaggatattttttttgggaagaaggttttggttttttttttgtattttatttgtattttgggtttgtttttttcgtttattattcggaacggttagtgttttatattcgattgtattgtggtattttcgaattttcgtttaattagttttttggcgtcgaagatggtgttggtggggtttatggttatttggtttttggcggcgtcgtcgatgaggcgttcggtgttcgtgaaggttacgtagttgggggtggtgcgattgttttggtcgttggcgatgatttttattttgttatgttggaagatttcgacgtacgaataggtggtgtttaggtcgatgtcgatagtcgggttacgggtagatattttgattgaaaggcgagcgacgttaggacgggaaaattagggagatgaatttcgcggagttaattaacggttatttcgaacgtattagaataaattatataagatttttatgtaagattattttttagtaatttattaggaattgtataaggaggtaaattggattttttttttgtttttatttttatttttttttttttgagatagagttttgtttttgttgtttaggttggagtgtagtggtgcgattttggtttattgtaatttttgtttttcgggtttaagcgatttttttgttttagtatttttagtagttgggattataggcgtttgttattacgtttaattttgtatttttagtagagatggggttttattatgttggttaggttggttttgaattattgattttaggtgatttatttattttagttttttaaagtgttgggattataggtgtgagttattgtattcggtttttttttaatttttaaataagttattttttggtaaatatagtatggtttttatagttattttttttttattttgatttttaatatgtttgtatatttaagagtgttgtgtttgttatataatttgttttttagtttgatggtgttttgtgtagattgagatatgaggattatgggattagtgtttagaattttgtaagttttttggaaatatagtatatttttttgttttagttagtagaatgtttgtgagttttgtgttgaagtttgggggttgagtggtagatattgtgtttttatttgatatttgatttgttgtttgaggatagagatgtagtgttatgggtgggagttgtgttttgttttattagtgtttagattttttaaaagataatggattttattttttgaaagaataggagatgaaaattaatgtttttttgtttttgtttttttttttttttatagttttttatttggtatatagtagaaaattttttggttatatttggtgtattttgttggtggaattttttaagaatgtatttttgattttttttttttttttttttttgagatagagttttgttgtattatttaggttggagtatagtgacgtgattatggttttttgtagttttaatttttttgttaaggtattttttttttttagttttttattttttggttttgttttaatagttgggattataggtttatgttattatacgtagttattttgtgtgtgtgtgtgtgtgtgtgtgtgtgtgtgtgtgtgtgtgtgtgtgtgtgtgtgtagagatggtgtttttttgtgttgtttggattgtttataaaatttgatatttaatagttttttgtttttatttattgagaaattggttttatttttttattgaaatgggagaagtgttatttattttattgtttttttaattaattaatttttttttttttgagatggagtttcgttttgttgtttaggttggagtgttgtggcgcgattttagtttattgtaagttttgttttttgggtttattttattttttttttgttttagtttttcgattagttgggattataagcgtttgttattacgtttggttagttgttgtgtttttttggtttgtttgtttgtttttgtttttttgttttttggggttttttttttgtatttttagtagaaatggggttttatcgtgttagttaggatggtttcgattttttgattttatgatttattcgttttagttttttaaagtgttgggatttataggtatgagttattgcgtttagtttaaattaattgatttttttgagatagagttttgtttttgttgtttaggttggagtgtaatggtacgatttgggtttattgtaattattgttttttgggtttaagtaatttttttgttttagcgtttcgagaagttgaaattacgggtgtttgttattatgtttagttaatttttttgtgtttttagtagagatagggttttattatgttggtttagttggtttcgaatttttgattttagatgatttatttgttttaggttgggattataggcgtgagttattatattgggtttttatgggattattttaagttaatatttaggaatttaaattataattagtattacgtagttacgtttaagaaagtatttttggggtcgggtacggtggtttatatgtgtaattttagtattttgggaggttaaagtaggtagtttatttgagtttaggagtttaagatcgatttgtgtaatatggtgaaattttgtttttatgaaaaaagtaaaaattagtcggatatggtggtatatgtttgtggttttaattgtttgggaggttgaggtgggaggattttttgaatttgggaggtagaggttgtaatgagttgagatcgcggtattatattttagtttgggtgatagagcgagattttgttttaaaaaaaaaaaaaaaaaaaagaatttt

SEQ ID NO: 79 - DNA, 1157 bp, Artificial Sequence
  Chemically treated genomic DNA (Homo sapiens)
ggattttgttttttttgaaggttttagggaagagtgttttttgtttttttcgaaggttttagggaagggtttgtttttttaggtttttggtggtttgtaggtgtagttttttaatttttttttttaagcggtttgttgtttataaggatacgagttatattggatgaggggtttattaattgatggtttttgtaaagtttttatttttaaataaggttatattgtgaggtattgggagttaggattttaatatagtttttttggtggatataatttaatttttaataacgtttatataattttaagtagggtttggtattttgtgtgttttttggagagcggttgagttaggttttggtagtgtttaggttatcggtgattgtagtttttggacggtatcgtttattataggttttggaggttgtttttacggttttttgatagggtttttgttggtttgggggtttttgattaggggagcggttttaggaggggagagattcgcgtttcgggtttagcgtagtcgtttcgagtaggatcgggatttttattaagcgggcgtcgttttacgattttcgcgcgtttttaggattattcgggtacgtggtaggtcgtttgtacgttcgcggattatttttgtgataggaaaaggtacgggttatttggtaaattaaggtatagagttttaggcggaagttgggaaggcgtcgttcggtttgtatcggtcgaagggttattcgggttaggcgtatagggtagcggcgttgtcggaggattagggtcggcgtgtcggcgtttagcgaggatgcgtagattgttttaggttcggcgtcgtcgtattgggtatgcgtcgattcggtcgggcgggaatatttcgtttcgttcgggtttcgttttagtttcgttttcgcgcgtttcggtttcgttttcgcgcgtttttttgttttttttaggttttcggtttcgtttcgttttagatttcgttttacgtcgttattttcgtgtttttcggtttcgttttcgcgtttcggatatgttgggatagttcgcgtttttagaacgttttgcgtttcgacgttcgtaggttttcgcggtgcgtatcgtttgcgatttggtgagtgtttgggtcgtttcgttttcggaagagtgcggagttt

SEQ ID NO: 80 - DNA, 1157 bp, Artificial Sequence
  Chemically treated genomic DNA (Homo sapiens)
gagtttcgtattttttcgggagcgaggcgatttagatatttattaagtcgtaaacggtgcgtatcgcgaggatttgcgggcgtcgggacgtaaagcgttttaggggcgcgggttgttttagtatattcggggcgcgggggcggggtcgaggggtacggggatggcggcgtggggcggggtttagagcggggcggagtcgaggatttgagaaaagtaagagagcgcgcgggggcggggtcggggcgcgcgggggcggagttggggcggagttcgggcggggcggggtgttttcgttcgatcgggtcggcgtatgtttagtgcggcggcgtcgggtttgaggtagtttgcgtattttcgttggacgtcggtacgtcggttttggtttttcggtagcgtcgttgttttgtgcgtttgattcggatggtttttcggtcggtataagtcgggcggcgtttttttagttttcgtttgaggttttgtgttttagtttgttaaatggttcgtatttttttttgttatagggatagttcgcgggcgtgtaagcgatttgttacgtgttcgagtggttttgaaagcgcgcgggggtcgtaggacggcgttcgtttagtgagaatttcggttttgttcggggcggttacgttgagttcggagcgcgagtttttttttttttggggtcgtttttttagttagggatttttagattagtagagattttgttagggggtcgtgggggtagtttttagggtttgtggtgggcgatgtcgtttaggggttgtagttatcgatggtttagatattgttagagtttgatttagtcgttttttagagagtatatagggtgttaggttttgtttggggttgtgtggacgttattaggagttgaattgtgtttattagagaagttatgttggagttttaatttttagtattttataatgtgattttatttggagatggggattttatagaagttattaattagtgggttttttatttagtatgattcgtgtttttataggtagtaggtcgtttggggaggaggattggagggttgtatttgtaagttattagaagtttaagaggatagatttttttttggagttttcggagggagtagaggatatttttttttggagtttttagagggagtaggattt

SEQ ID NO: 81 - DNA, 5881 bp, Artificial Sequence
  Chemically treated genomic DNA (Homo sapiens)
gggagatgaggtgggaggattgtttgagtttaggagtttaagattagttcggggtaatatagtgaaattttgtttgtataaaaataaatttcgggagcgtggttgagcggttggcgcggttgttttggagtaggggcgtaggaattttgatgtgaaattaatagtttgtgagttttggaatttttatttagagaagatgaaggatatcgatataggaaaagagtatattatttttagttttgggtatagaagtgtgagggagagaattagtatttttgggacgtatagagatcgtgaagattttaagtttaggagaattcgatcgttggaatgttaagatgttttggaaatagtagttcgagtcgagggttttttttttgatgtttttatgtatttttagtttagaattttggatgaggagtattttaagggaaagtattattatggtttgagtgttttgaagtttattcggattatttttaaatattagtatttagtggataatgttgggttttttttttgtatgattttttcgtggtttttttttttggttcgtgtggtttataagaagggggagtttttaatggaagacgtgtggtttttgtttaagtacgagttttttgacgtgaattgtagaagattagagagattgtggtaagaagagttgaatgaagttgggttagacgttgtttttttgcgaagggttgtgtggattttttgtcgtattaggtttattttgtttatcgtgtgtttgatgattacgtagttggttggttttagtggattagtttttatggtgaaatattttttggagtatatttaggtaatagagtttaatttgtagtatagtttgttgttagtgttgggtttttttttgacggaaatcgtgcggttttggtcgtttgtattgatttgggcgttgaattatcgaatcggtgttcgtttgcggggggttattttaattatggtatttaagaagatttttaagttaaagaatattaaagagaaatttttgggtgagtttattaatatttgttttaacgatgggtagagaatgtttgaggtagtagtcgttggtagtttgttggttggaggattcgttgttgttattttaggtatgatttataatgtaattattttgggattaataggttttttgggattagttgtttttatttttttttatttagtaatgatgtttgtattacggtttatagtatattttaggagaaaatgcgtggtcgttacggatgaacgtgtttagaagatgaatgaagtttttatttatattaaatttattaaaatgtatgtttgggttaaagtatttttttagagtgtttagaaaattcgcgaggaggagcgtcggatattggaaaaagtcgggtatttttagagtattattgtgggtgtggtttttattgtggtggtgattgttagcgtggtgattttttttgtttatatgattttgggtttcgatttgatagtagtataggtttttatagtggtgatagtttttaattttatgatttttgttttgaaagtaatatcgtttttagtaaagttttttttagaagttttagtggttgttgatagatttaagagtttgtttttaatggaagaggtttatatgataaagaataaattagttagtttttatattaagatagagatgaaaaatgttattttggtatgggattttttttattttagtatttagaattcgtttaagttgatttttaaaatgaaaaaagataagagggtttttaggggtaagaaagagaaggtgaggtagttgtagcgtattgagtattaggcggtgttggtagagtagaaaggttatttttttttggatagtgacgagcggtttagtttcgaagaggaagaaggtaagtatatttatttgggttatttgcgtttatagaggatattgtatagcgtcgatttggagatttaagagggtaaattggttggaatttgcggtagtgtgggaagtggaaaaattttttttattttagttattttaggttagatgacgtttttagagggtagtattgtaattagtggaattttcgtttatgtggtttagtaggtttggatttttaatgttattttgagagataatattttgtttgggaaggaatatgatgaagaaagatataattttgtgttgaatagttgttgtttgaggtttgatttggttattttttttagtagcgatttgacggagattggagagcgaggagttaatttgagcggtgggtagcgttagaggattagttttgttcgggttttgtatagtgataggagtatttatattttggacgatttttttagtgttttagatgtttatgtgggtaattatatttttaatagtgttattcggaaatattttaagtttaagatagttttgtttgttatttattagttatagtatttggttgattgtgatgaagtgatttttatgaaagagggttgtattacggaaagaggtatttatgaggaattgatgaatttaaatggtgattatgttattatttttaataatttgttgttgggagagatatcgttagttgagattaatttaaaaaaggaaattagtggtttatagaagaagttataagataagggttttaaaataggattagtaaagaaggaaaaagtagtaaagttagaggaagggtagtttgtgtagttggaagagaaagggtagggtttagtgttttggttagtatatggtgtttatatttaggttgttgggggttttttggtatttttggttattatggttttttttatgttgaatgtaggtagtatcgtttttagtatttggtggttgagttattggattaagtaaggaagcgggaatattattgtgattcgagggaacgagatttcggtgagtgatagtatgaaggataatttttatatgtagtattatgttagtatttacgttttttttatggtagttatgttgattttgaaagttattcgaggagttgtttttgttaagggtacgttgcgagttttttttcggttgtatgacgagttttttcgaaggatttttcgaagttttatgaagttttttgatacgatttttatagggaggatttttaataggttttttaaagatatggatgaagttgacgtgcggttgtcgttttaggtcgagatgtttatttagaacgttattttggtgtttttttgtgtgggaatgatcgtaggagttttttcgtggttttttgtggtagtggggttttttgttattttttttttagttttgtatattgtttttagggttttgattcgggagttgaagcgtttggataatattacgtagttatttttttttttttatattacgtttagtatatagggttttgttattatttacgtttataataaagggtaggagtttttgtatagatattaggagttgttggatgataattaagtttttttttttttgtttacgtgtgcgatgcggtggttggttgtgcggttggattttattagtatcgtttttattattattacggggttgatgatcgtttttatgtacgggtagatttttttagtttatgcgggtttcgttattttttatgttgtttagttaacggggttgttttagtttacggttagattggtatttgagatagaagttcgatttatttcggtggagaggattaattattatattaagattttgtttttggaagtatttgttagaattaagaataaggtttttttttttgattggttttaggagggagaggtgatttttgagaacgtagagatgaggtatcgagaaaatttttttttcgttttaaagaaagtattttttacgattaaatttaaagagaagattggtattgtggggcggataggattagggaagttttcgttggggatggttttttttcgtttggtggagttatttggaggttgtattaagattgatggagtgagaattagtgatattggttttgtcgattttcgaagtaaattttttattattttttaagagtcggtgttgtttagtggtattgttagattaaatttggatttttttaattagtatattgaagattagatttgggatgttttggagaggatatatatgaaagaatgtattgtttagttatttttgaaatttgaatttgaagtgatggagaatggggataattttttagtgggggaacggtagtttttgtgtatagttagagttttgtttcgttattgtaagattttgattttagatgaagttatagttgttatggatatagagatagatttattgatttaagagattattcgagaagtatttgtagattgtattatgttgattattgtttatcgtttgtatacggttttaggtttcgataggattatggtgttggtttagggataggtggtggagtttgatattttatcggtttttttgtttaacgatagttttcgattttatgttatgtttgttgttgtagagaataaggtcgttgttaagggttgatttttttttgttgacgaagttttttttttttagagtattgttattttttgtttggggcgggttttttatcgcgtttttttatcgaaattttgtttttttcgattttatttttcgtatagtagtttcggattggtttgtgtgttttatttttagggagagttatattttgattattgtatttattttatatttatgtaaataaaatttagtttttgtttttaattgtattttaaaaggtttagggaatcgttattataattgtattagaggtttataatgaagttttatacgtgtagttatatttatatataattttgtatatagtttatatttatagtgaaaatgtaagttgtttattttatattaaaataagtattgtgttaataatagtgtatatttttttttattatttttgtatagtttgttgtattagagatttggttttgttattagattgtaggaagagtagtattttatttttttttagttggtggttttacggtgttaggttttttgggtgtttaaaggaagacgtgtggtaatagtgggtttttcgatagttttttttgtcgtttttttatagtcgttttaggggtggttggagacgggtgggcggttggagattatgtagagcggtcgtgagtttttagggtttttgttttttgttttggtgttatttattgtttttgttaggagagtagcggggcgaagtttaggtttttttttattttttttattaatgaatggggattatagagatattttttcgagtcggggagttttttttttgtttttttttttttgttgttgtttttaaataagaattagtttatttatagagagttttattgttttaggtttttatggttggttattgtatagagttttttagttttaagatttgttggttttaagttttggagttaattgttgttttttgaggtggtatttttttatttgtttatttttatatttttatagtttagtggtagggtttaggatttcgtgggtttgttttttttttttatcgtagtcgtcgtatagtttttttttttttttttttttaaagtttgtaattttaagtagtttttgttaattagtgttttatattggcgtagaagtttttgtattgtaaagagatttattttaggttgttggttgttgtgtggtttggtgtgttttcgtaaattttttttgtgttgtggggttggtagtttaggtgggcgtggttattgttgttattagttgaatggttagcgttgtatgtcgtgattaattagatattttgtcgttttagtatgtttgttgaatattttgtggaagtaaaaatttgaaaatgtgaataaaattattttggattttgtaaaattt

SEQ ID NO: 82 - DNA, 5881 bp, Artificial Sequence
  Chemically treated genomic DNA (Homo sapiens)
gagttttataaaatttaaaataattttatttatatttttagatttttgtttttataaggtgtttagtaaatatgttaaggcgatagaatgtttagttggttacgatatgtaacgttgattatttaattgatgatagtagtgattacgtttatttgagttattagttttatagtataaagggggtttgcgggaatatattaaattatatagtaattagtaatttgaggtaggtttttttatagtataaaaatttttacgttagtgtgagatattgattagtaagagttgtttaaagttgtagattttgaggggagagagagagagagattgtgcgacgattgcggtgagaaaggaaaatagatttacgaaattttgagttttgttattgaattgtggaggtgtgggaataggtaaatgaaaaagtgttattttaaaaagtagtagttggttttagggtttggaattaataggttttggagttggagagttttgtgtagtggttagttataggaatttgaggtagtgggattttttgtggatagattgatttttgtttagaaataatagtaaaaagaagaaggtaggaaagaaatttttcggttcggaggaatgtttttgtgatttttatttattgatggagggagtgaaaaggggtttgggtttcgtttcgttgtttttttgatagaaatagtaagtgatattaggatagaaggtaggagttttgagaatttacggtcgttttgtatggtttttagtcgtttattcgtttttagttatttttggagcggttgtggggaggcggtagagggggttgtcggagggtttattattgttatacgtttttttttggatatttagaaaatttggtatcgtgaaattattagttagagaagaatgaaatgttattttttttatagtttaatagtaaaattagatttttagtatagtaaattgtataaaaatgatagaaaggaatatgtattgttattagtatagtgtttattttaatataaaataaatagtttatatttttattgtaaatataggttatgtatagaattatatatagatatagttatacgtataaagttttattataggtttttgatataattataataacggttttttgaattttttagagtgtaattaagaataaaaattaaattttgtttatatgaatatggaataaatataataattaaaatatgattttttttaaaagtgaaatatataagttaattcggaattgttgtgcgaaagataaaatcgagaaaggtaaggtttcggtaggaggacgcgatgaggggttcgttttaggtagggaatggtaatgttttaaagaaaagagatttcgttaatagggaggagttagtttttgatagcgattttgttttttgtagtagtaaatatggtatagaatcgggaattgtcgttggatagaaggatcgatggggtgttaaattttattatttgtttttgggttagtattataattttatcggagtttagaatcgtgtgtaggcgatgggtaatggttagtatggtatagtttgtaaatgtttttcggatggttttttgaattaataagtttgtttttgtgtttatggtagttgtggttttatttaaaattagaattttatagtggcggagtagggttttagttatgtataagagttgtcgtttttttattgagaagttatttttattttttattattttagatttaagttttagaggtagttgagtaatatatttttttatgtgtgttttttttagggtattttaaatttggtttttagtgtattggttgaaggggtttaaatttgatttgatagtgttattgaatagtatcggtttttgaggaatgatagagagtttgtttcggaggtcggtaaggttaatattattgatttttattttattaattttgatgtagtttttagataattttattagacggaagagggttatttttagcgaggatttttttgattttgttcgttttataatgttaattttttttttaggtttgatcgtgaaggatattttttttaggacgagagggaggttttttcggtattttatttttgcgtttttaaaggttattttttttttttggggttagttaggggagggagttttgtttttaattttggtaggtgtttttaaggatagagttttaatgtagtgattgattttttttatcgaggtgaatcgagtttttgttttagatgttagtttgatcgtaaattggaatagtttcgttaattggatagtataagagatggcgagattcgtataggttgggggaatttgttcgtgtataagaacgattattagtttcgtggtggtgatgagggcgatgttgatgaggtttagtcgtatagttagttatcgtatcgtatacgtaaataaaaaaaaaggagtttggttgttatttagtagtttttggtatttgtgtagaaatttttgttttttattgtaggcgtggatggtggtaaggttttgtatgttggacgtgatgtgggagaggaaaggtgattgcgtgatattgtttagacgttttagttttcgaattaggattttggagataatgtgtaggattgaaaagaggatgataaggggttttattgttataaggaattacgggaagatttttgcgattatttttatatagaagaatattaggataacgttttggatgaatatttcggtttggaacggtagtcgtacgttaattttatttatgtttttggaaaatttgttgagaattttttttgtgggggtcgtgttaaaaaattttatagggtttcgaaggatttttcggaaaagttcgttatgtagtcgggaggaagttcgtagcgtgtttttgataaagataatttttcgaatggtttttaggattagtatgattgttatggagagggcgtagatgttggtatagtattgtatatgaggattgttttttatgttgttatttatcgaggtttcgttttttcgagttatagtggtgttttcgtttttttgtttgatttagtaatttaattattaggtgttgaaggcggtgttgtttatatttagtatgaaaagggttataataattaggaatgttaaggggtttttagtagtttggatgtagatattatatattgattagggtattgaattttgtttttttttttttagttgtataagttgttttttttttggttttattgttttttttttttttattgattttgttttaggatttttgttttgtgattttttttgtgaattattggtttttttttttgaattgattttaattggcggtgttttttttagtaataggttattaaaaatggtagtatagttattatttaaatttattagttttttatgggtgttttttttcgtaatatagtttttttttatgaagattattttattatagttaattaggtattgtaattggtgggtaataaatagaattgttttggatttgagatgttttcggatagtattattgaagatgtggttgtttatatgggtatttaaggtattgagggggtcgtttaggatgtagatgtttttgttattatataaggttcgggtaaggttgattttttggcgttgtttatcgtttaggttggtttttcgttttttaattttcgttaggtcgttgttgggaagaatggttaggttaggttttaggtagtagttgtttagtatagagttgtatttttttttattatatttttttttaaataggatgttgttttttagagtagtattgaggatttaggtttgttgggttatataagcgaaggttttattgattgtaatgttgttttttagaagcgttatttggtttaaaatggttgaaatgagagaggtttttttattttttatattgtcgtagattttaattagtttatttttttggatttttagatcgacgttgtgtagtgttttttgtaagcgtaggtggtttaggtggatgtgtttgtttttttttttttcgggattgggtcgttcgttattgtttaggaggaggtggtttttttgttttgttagtatcgtttgatgtttagtgcgttgtagttgttttatttttttttttttgtttttggaagtttttttgtttttttttattttgggggttagtttgggcgagttttggatattggagtgggaggagttttatgttaaggtggtattttttatttttattttgatgtgaggattggttggtttgttttttattatgtgaattttttttattagaaataaatttttaaatttgttaatagttattgaggtttttgagagggattttattgaaaacggtgttatttttaaagtaaaagttatggaattgaagattgttattattgtgaaagtttgtgttgttgttagatcgaagtttagggttatatgaatagagaaggttattacgttggtaattattattataatgggagttatatttatagtgatgttttggaagtattcggttttttttaatattcgacgttttttttcgcggattttttgaatattttgagaaaatgttttgatttaggtatatattttgataaatttaatgtaagtaagaattttatttattttttggatacgtttattcgtggcggttacgtatttttttttgaaatatgttgtgagtcgtgatgtaaatattattgttgggtaaaagaggataaaaatagttgattttaggaagtttgttggttttagaataattatattataaattatgtttaagatggtaataacgggttttttagttagtaggttgttaacggttgttgttttaaatattttttgtttatcgttggagtaaatgttgatgagtttatttagggatttttttttaatgttttttaatttaaggatttttttaaatgttatggttaggatggtttttcgtaagcggatatcggttcggtaatttaacgtttaagttagtgtaagcgattaagatcgtacgattttcgttaggaggaggtttagtattaataataagttgtattgtaggttagattttgttgtttgggtatattttaagaggtgttttattatgaaggttggtttattgaagttagttagttgcgtgattattaggtatacgatggataggatgagtttggtgcggtagaagatttatataatttttcgtagggaagtagcgtttggtttaattttatttagttttttttgttatagtttttttagttttttgtagtttacgttagaagattcgtgtttggatagagattatacgttttttattgagagttttttttttttgtgggttatacgggttagagaagaaagttacgaaaaagttatataggaaaaaagtttagtattgtttattgggtgttggtgtttggaagtagttcggatgggttttagagtatttaagttatgatggtatttttttttgggatgttttttatttaggattttgagttgagaatgtatggaggtattaagagagaggttttcggttcgggttgttgtttttaaggtattttggtattttaacggtcgagtttttttgaatttggaatttttacggtttttgtgcgttttagaagtgttggtttttttttttatatttttatatttaggattggggatgatatattttttttttatgtcgatattttttattttttttgagtggaggttttagggtttatagattgttagttttatattagaatttttgcgtttttgttttaggataatcgcgttagtcgtttaattacgttttcgagatttatttttgtatagatagggttttattatgttgtttcgggttggttttgaatttttgggtttaagtaatttttttattttatttttt

SEQ ID NO: 83 - DNA, 1092 bp, Artificial Sequence
  Chemically treated genomic DNA (Homo sapiens)
aagttttttttttattatttaagaaggtatttaggtttttttgtgttaggttttaggtaaagtgttggattatttagtaattgggtttagtagtaggatggttttagattgaggttttagggttaaaggattatttttttttttagcgttggttcgggaaaggtaagtttcgggcgggagcgtacgtcgcgttttcgaagtttggttttttcgttacgtttattttttgtttttatttcgcgtttttttaggttttttttcggtgaatcggatgttttgttagttttttattttgcgttttcggtcgcggttcgggtttttcgtaaagtcgttgttatttcggagggtttagttagcgggttttcggaggttggtcgggtaggcgtggtgcgcggtaggagttgggcgcgtacggttatcgcgcgtggaggagatattgttttgtcgcgatgggggttcggggcgtttttttacgtcgtaggtaagcggggcggcggttgcggtatttgtttatcgggagttttttttttttttttttgttgttgttgttttgtatttagttcgggggaggatagaagaaaaaggaggtagaatggatttttttggtttttttttgtggtcgggggcgggttagggtgggtcgcgttgtttaggtagttttgtcgtgttgttaggtagtttggtcgtcggcgtgggcgatgtcggcgttggggcgggagtcgcgagggtgggaggttttggggcgttttcgggacgtggagttagtagggttttgatttgaaaaacgacggtaaagcgtgtttttgattgtttttgagtattttatattttttagatttagggcgtttttatttttagttggaagtttagtttagagtaatggtgttattaaaaggggtgtgttggatgtgaaaatattttttggaagtatttataagtttgtaggaaatatgttttttttatttttttattttgttttttttattatttattttaagaagtaatagaatttgtgtagagtgtgttttaagttatattgtatgtttatttttgtttatgttgaattcggtgtatatttgtgagaataagttt

SEQ ID NO: 84 - DNA, 1092 bp, Artificial Sequence
  Chemically treated genomic DNA (Homo sapiens)
aagtttatttttataagtatatatcgagtttaatataaataaaaataaatatatagtgtaatttaaaatatattttgtataggttttgttgttttttgaaatgggtaatgaagggagtagagtaagaaaataaggaaaatatattttttgtaggtttataaatatttttaaagggtatttttatatttaatatattttttttagtggtattattgttttaagttgggtttttagttgggaataaaggcgttttgggtttgaaaggtgtgaggtgtttagaagtagttaagaatacgttttgtcgtcgttttttaagttagaattttgttaattttacgtttcggaaacgttttagggttttttattttcgcggttttcgttttagcgtcggtatcgtttacgtcggcgattaggttgtttagtaatacggtagggttgtttgggtaacgcggtttattttggttcgttttcgattataggggaaggttaaggggatttattttatttttttttttttttgttttttttcgagttggatgtagagtagtagtagtaggagaaggaagggaaagttttcggtgggtaggtatcgtagtcgtcgtttcgtttgtttacggcgtgaaggagcgtttcgggtttttatcgcggtagggtagtgttttttttacgcgcggtagtcgtgcgcgtttagtttttatcgcgtattacgtttgttcggttagttttcgggagttcgttggttgggtttttcgggatggtagcggttttgcgagggattcgggtcgcggtcgaggacgtagagtaggagattgatagagtattcggtttatcgggagaagatttggaaaggcgcgggatgggggtaggaagtgggcgtggcgagggagttaggtttcgggggcgcggcgtgcgttttcgttcggagtttgtttttttcggattagcgttgaggagaggagtggttttttggttttgggattttaatttgaggttattttgttattgaatttaattattgggtagtttagtattttatttggggtttagtatagaaagatttgaatgtttttttggatgatgaaggggaagttt

SEQ ID NO: 85 - DNA, 3647 bp, Artificial Sequence
  Chemically treated genomic DNA (Homo sapiens)
tatggtttagtttttagtttagttttgtgattttgggaaagtttttttagttcgtggaattttaaggtttaaggttttttttttgtaaaatggggaatgataatatttgttttttttggagttttggggatttagtgttttgaggaacgtggttgtaggttagagtggtatagagtagggtttaatgaagtatggcgtttatagtagtttttttgattggattaattttttcggatataatagtagggtaggggtggggtttggggagaaaggatatttttaattttgattttaatatttcgatggtttttaaggttgtttgtatatttatttaggtgtaagttttttaaggtgtggtgtgatgaattagtgatttttggagttaggttagcgtatttttttttcgtagggttgtaagttgtaggattgagaggtaggttgattaggttttgggttggatgatggggtgagagtaaggggttagttttgatatatgtttaatttttttttttagttttaagatattttgggtaaattgtttattttagtttttttgatttttattttaattttaatattagtttaagagaaaatagggatattgatggttatttagaagggttgttgtgttttatatatagtaatatttttcgaatgtttgtgatagcggtttaaggaataagttaattttatattattattttggatatttgtataaaattttattttatttttattatatgaatgtgttagggttgtttttttgttttgttttttttttttttttttgagatagagtttcgtttttgttgtttaggttggagtataatggcgcgattttggtttatcgtaattttcgttttttaggtttaagcgatttatttgttttagttttttcgagtagttgggattataggatgcgttattatgttcggttaattttgtgtttttagtagagatagggtttttttatgttggttaggttggtattaaattttcgattttaggtgatttatttgttttggttttttaaagtgttgtaattataggtatgagttatcgtatttagtcgtgttagggtttttttttgtttaatttttttttttttttttagtttttttttgtttgttttaatggagttttattttgttatttaggttggagtgtagtggtaagatttagtttattgtaatttttgttttttgagtttaagtaatttttttgttttagtttttcgagtagttgggattataggtgtttgttattatatttagttaatttttgtatttttagtagagatggggttttgttatgttggttaggttggtttcgaatttttgatttcgtgatttgtttgttttggttttttaaagtgttgggattataggtatgagtcgttatattcggttaatttttgtattatttttttaaagagagttttttaaattatataagttttaggttttataaaatttagatttgttttagtataattaaatttgggattatttattgagtaattattatgtgttaagtattgcgttgagtgtttttagagtattattttttttaattttagtatagtatgttagatgttgttttatagatgagttaattgagattagagatgtttagttatttgtttaaggtgatatgattgatatggaatagagttaagatttttttttttttttttgatacggagttttattttgttttttaggttggagtgtagaggcgtaattttagtttattgtaagttttgttttttaggtttacgtatttttttgttttagttttttgagtagttgggattataggtattcgttattatatttggttaattttttgtatttttagtagagatagggttttatcgtgttagttaggatggtttcgattttttgatttcgtgatttgtttgtttcggttttttaaagtgatggaattataggtgtgagttatcgcgattggttagatttaagatttgaatttaggtttttttggttttagaggtttttgttttttaattttttagtatgtatacgtatttgtttttttagaggtgtttgtttaagtgtgtttagtatatggaagtaagttagaaatgttaggtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgttcgtggttgtaattttagtattttgggaggttgaggcgggaggattatttgagtttgggagtttaagattagttttattaacgtggagaaattttgtttttattaaaaatataaaaaatttagttggttatggtggtatatgtttgtaattttagttgttcgggaggttgaggtaggagaattatttgaattagggaggtagaggttgtggtgagtagagatcgcgttattgttttttagtttgggtaataagagtaaaagttcgtttaaaaaaaaaaaaaagttttttcgatgtgattgtttttttttaaatttgtagatttttttaagattatgttttttagatattttaaagattttagaagatatgtttcgggggttttggaagttataaggtaaatataatatatttttttttttgattattaattttattagaggatgtggtgggaaaattattatttgatattaaaataataggtttgggatggagtaggatgtaagttttttaggaagttagataattgagatttaaagggtgttaagagtggtagtttagggaaatttatttcggatttcgggggagggggtagagttattagtttttgtatttagggatttttcgaggaaaagtgtgagaacggttgtaggtaatttaggcgtttcggcgttaggagggacgatttaggtttgcgcgaagagagggagaaagtgaagttgggagttgtcgatttttagatttcgttggaatgtagttggagggggcgagttgggagcgcgtttgtttttaattatcggagaaggaggaggtggaggaggagggttgtttgaggaagtataagaatgaagttgtgaagttgagatttttttttattgggatcggagaaattaggggagtttttcgggtagtcgcgcgtttttttttacggggttttttattgcgtcgcgcgttcggtttttatttttcgtagtatttcgcgtttcgcgtttttttagtcgggtttagtcggagttatggggtcggagtcgtagtgagtatt

SEQ ID NO: 86 - DNA, 3647 bp, Artificial Sequence
  Chemically treated genomic DNA (Homo sapiens)
ggtgtttattgcggtttcggttttatggtttcggttggattcggttgggagggcgcggggcgcggggtgttgcgaggggtgggggtcgggcgcgcggcgtagtaaagggtttcgtgggaaggggcgcgcggttgttcggggggtttttttggttttttcggttttaatggaggggaattttagttttataattttatttttatatttttttaagtagttttttttttttatttttttttttttcggtgattgggagtaagcgcgtttttagttcgttttttttaattgtattttaacgaagtttgggagtcggtaatttttagttttatttttttttttttttcgcgtaggtttgggtcgttttttttagcgtcgggacgtttgggttgtttgtagtcgtttttatattttttttcggagaatttttaaatgtagaggttggtgattttgttttttttttcggagttcgggataaatttttttaggttgttatttttaatattttttaagttttagttatttaattttttggggagtttgtattttattttattttaagtttattgttttaatattaaataatggtttttttattatattttttagtaaaattgatagttaaggagggggatgtgttgtgtttattttgtggtttttaggattttcggggtatattttttggaatttttgaagtatttgaaaagtatgattttaagagggtttataaatttgggaggagatagttatatcgaaaggatttttttttttttttaaacgaatttttgtttttgttgtttaggttggagagtaatggcgcgatttttgtttattataatttttgtttttttggtttaagtgatttttttgttttagtttttcgagtagttgggattataggtatgtgttattatgattagttgaattttttgtatttttagtaaagatagggtttttttacgttggtgaggttggttttgaatttttaagtttaggtgattttttcgttttagttttttaaagtgttggaattataattacgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatttagtatttttaatttgtttttatgtgttgagtatatttaagtaggtatttttagagggataggtgcgtatgtatgttagggagttgagaaataggggtttttgggattaagaggatttgggtttaaattttgaatttggttagtcgcggtggtttatatttgtaattttattattttgggaggtcgaggtaggtagattacgaggttaggagatcgagattattttggttaatacggtgaaattttgtttttgttaaaaatataaaaaattagttaggtgtggtggcgggtgtttgtagttttagttatttaggaggttgaggtaggagaatgcgtgaatttgggaggtagagtttgtagtgagttgagattgcgtttttgtattttagtttgggagatagagtgagatttcgtgttaaaaaaaaaaaaaaaaattttgattttattttatattagttatgttattttgggtaagtgattgagtatttttggttttagttggtttatttgtaaaatagtatttgatatattatgttggggttaaaggagataatgttttggaagtatttagcgtaatatttggtatataataattgtttaataaatggttttagatttagttatattggggtagatttaggttttgtggggtttgaagtttatataatttgggaaattttttttaagaaagtaatataaaagttggtcgagtatggcggtttatgtttgtaattttagtattttgggaggttaagataggtagattacgaggttaggagttcgagattagtttggttaatatgataaaattttatttttattaaaagtataaaaattaattaggtgtggtggtaggtatttgtaattttagttattcgggaggttgaggtaggagaattgtttgaatttagagggtagaggttgtagtgagttgagttttgttattgtattttagtttgggtgatagagtaagattttattgaaataaataaagagaggttaaagagagagaaaggaattgaatagaaaaagattttagtacggttgggtgcggtggtttatgtttgtaattgtagtattttgggaggttaaggtaggtggattatttgaggtcgggagtttggtattagtttgattaatatggagaaattttgtttttattaaaaatataaaattagtcgggtatggtggcgtattttgtaattttagttattcgggaaggttgaggtaggtgaatcgtttgaatttgggaagcggaggttgcggtgagttaagatcgcgttattgtattttagtttgggtaataagagcgaaattttgttttaaaaaaaaaaaaaaaaaataaaataaaaaaataattttagtatatttatatagtaaggataaggtggagttttgtataggtatttagagtgataatgtaaaattaatttattttttggatcgttgttataaatattcgagaaatattgttgtgtatggaatatagtagtttttttggatggttattaatatttttatttttttttgagttggtgttagggttagggtgaggattaggggaattgaggtaagtaatttgtttaggatgttttagggttagagagaaaagttgggtatgtattaaaattgattttttatttttattttattatttagtttaggatttggttaatttgttttttagttttgtagtttatagttttgcgggaagaggatgcgttgatttggttttaggagttattggtttattatattatattttggagggtttgtatttggatgagtgtgtaggtagttttagaggttatcgggatgttaggattagggttagaggtgttttttttttttaggttttatttttgttttgttgttgtgttcggaaaggttagtttagttaggaaagttattgtggacgttatgttttattggattttattttgtgttattttgatttatagttacgttttttagaatattgagtttttaagattttagaggaggtaggtgttattattttttattttgtagaagaggaattttgagttttgagattttacgagttaaaggaatttttttaaggttatagagttgagttgggaattgagttatg

SEQ ID NO: 87 - DNA, 2205 bp, Artificial Sequence
  Chemically treated genomic DNA (Homo sapiens)
ggatttttagtaggggagtaatatggatttggaaagattattttggttgttgtgtggggatagataagacggtgggagtttagaaaggaggttgggttggaaattttgggatagaaatttagagaggaaaagattgggtttggggtttttagtgagtattagggagtggggaattagtaggagtttggtttttatttatttttttttttttttttttttttttttttgtaggttggtttcggttttatttttaggtgtggttttaggatagttttggtcgttgttagtttgtaggttatggattttgttatgtgtttagtagttcgggtatttattagttggtttgttttacgtggcggtttttgggtagttggcgagaatagttggtacgggttttcgtgggtggtgggtcgtagttgttgtatggggatattatttatagtggggtcgatcgttatcgtttgtatatagttgttggtggtatcgtgtatttggagatcggtttgttgtttcgtaatttcgatcgttacggcgtggagtgttgagggattttgtttttaacgttattattatttatatttcggatatttagtgatgggggaggatggtatagtggttaagagtatagattttagagattgttagagttgattttagttaaggtatggtatcgtttttgttttttttaggatttcggggtttttttgggtttagtttttttatttgtaaattggggatagtaaatgtatggggtcgtagggtgttgagtgataggaggttgtttagttatatgggaggtgtttagtaaaggagagtaatttttataggtgtttgttttttgatttttttattttttaggtgttttgttgttttttttttttattgatatttttcggaggtttttatgttgatagatttttttttttttattttgttttttagtttgatttttttttcgttttgggttttttttttttggtcggtttttttgtgttttatttttcggattaagtttttttcgtttggttttttttttttggtgatttatatcgttcgtaaagttatagcgtatttggattattcgttttggtggcgtttggtcgttaggaggtagtattttgtttgcggggcggagtcggggagttcgtttttttttttttagggttgaagggatttttttcggagttcgtttacgcgagatgaggacggtggtttagtttttttatgttttttttttgggggtcgttttcgttttcgtttcgtgcgttttttgggtggggtcgggggcggttttaaaattttttgtcgatttagtcggttttcgtcgtcgtcgtttttcgcgttttgggttattttttttttattttttttcgcggagtagttagatagcgagggtttcggtcgggggtaggggggacgtttcgttcggggtattttttcggttttgagtcgttcgcggggtcggtttcggttcggagcggaggaaggagtcgtcgaggagtagtttgaggttttagagtttgagacgagtcgtcgtcgttttcgttattgcggggaggagggggaggaggagcgggaggagggacgagttggtcgggagaagaggaaaaaaatttttgagattttttcgttgtcgttgggagtcggaggcgcggggattttttggcgcgacgttgtttcgcgaggaggtaggatttggggattttagatcgtttttttttgtcgtcggggacgtttgttttttttttgttttttatacggcgttttttaggcgtttttatttcggattagttttcgggagtcgtcgattcggtttttcgtaaagatttttttttagatttcgggcgtattttttgtacgtcgtttttattttcggtttgttttttgagttttcgcgtattttagatttttttttttttaggagacggattttttttcgatttgttatagattttttatttaagattatttattttttggtattagatcgcgtttatttaggttattttcgtgggatattgagatattttcggtttaagttttttttttattattgcgtttttttttttgaggagttttagttttttttcgaggtttttttattttttgtcgggagatttttagtttttgtaggggcggggtttttttattatattagttttgttcgcgttttcggtagtgtcggggggcgtcgttttttttatg

SEQ ID NO: 88 - DNA, 2205 bp, Artificial Sequence
  Chemically treated genomic DNA (Homo sapiens)
tatgggggaggcggcgtttttcggtattgtcgagagcgcgaatagggttggtgtggtggggaggtttcgtttttgtaggggttgggggtttttcggtaaaaggtaggagggtttcgagggaaagttgaggttttttagggagaagggcgtagtggtggaggggaggtttggatcgggggtgttttagtattttacggaaataatttagatgggcgcgatttggtattagaaggtgggtggttttgaataggggatttgtggtaggtcggagagagattcgttttttggaggagaaagggtttaggatgcgcgggggtttaggagataggtcggggatgaaggcggcgtgtagggggtgcgttcgaggtttggggaaaagtttttgcgggaggtcgggtcggcgattttcgagggttggttcggaatgggggcgtttgagggacgtcgtgtagggggtagggagggagtaagcgttttcggcggtaaagggaggcggtttggggtttttaagttttgttttttcgcggggtagcgtcgcgttaagaggttttcgcgttttcggtttttagcggtaacggaaaagttttaaaagtttttttttttttttttcgattagttcgttttttttttcgttttttttttttttttttttcgtagtggcgggggcggcggcggttcgttttagattttggggttttaggttgtttttcggcgattttttttttcgtttcgggtcgaggtcggtttcgcgggcggtttagagtcgggggggtgtttcggacggggcgttttttttgttttcggtcggggttttcgttgtttggttgtttcgcggagggaggtgggagggagatggtttagggcgcgaagggcggcggcggcggggatcggttgggtcggtagggggttttgaagtcgttttcggttttatttaggaagcgtacggggcgggagcgggggcggtttttagggggagggtatgggggggttgggttatcgtttttatttcgcgtgggcgggtttcgaggggggtttttttagttttgggggaaagggggcgggtttttcggtttcgtttcgtaaatagggtgttgttttttggcggttaagcgttattaaagcgggtgatttagatgcgttgtggttttgcgggcggtgtgggttattagagaaagaggattaggcggagaaggtttaattcgggggatgagatataggggagtcgattagaggagggggatttagaacggaaggagagttaggttgggaaataaggtaggagaaggagggtttgttaatatgggggttttcggagggtgttagtgggaggagggggtaataggatatttgagggatggaagggttaggaggtagatatttgtaagaattgtttttttttattgagtattttttatgtggttaagtagttttttgttatttaatattttgcgattttatatatttattgtttttaatttatagatagggaaattgggtttagagggatttcgaggttttagaaaggatagaagcggtgttatgttttagttggggttagttttgatagtttttagagtttgtgtttttgattattgtgttatttttttttattattgggtgttcggggtgtggatggtggtgacgttggaggtagagttttttagtattttacgtcgtagcggtcgaagttgcggagtagtaggtcgatttttaggtgtacggtgttattagtagttgtgtgtaggcgatagcggtcggttttattgtagatggtgtttttatgtagtagttgcggtttattatttacgaaagttcgtgttaattgttttcgttaattgtttaggggtcgttacgtggggtaggttagttggtgggtgttcgggttattgggtatatggtaaaatttatagtttgtaagttggtagcggttaaagttgttttgggattatatttggaaatggagtcggggttagtttgtaggaaaggagagagaggggaaaggagggatgggtggggattagatttttgttgattttttattttttgatatttattggagattttaggtttagtttttttttttttgggtttttgttttagagtttttaatttagttttttttttaggtttttatcgttttatttatttttatatagtagttaaagtgatttttttaaatttatgttatttttttgttaaggattt

SEQ ID NO: 89 - DNA, 3037 bp, Artificial Sequence
  Chemically treated genomic DNA (Homo sapiens)
gaattttcgaaattttttttgtagaaaattttggaaggtgtttgttatattgattttggaatgtgtgtttatttggggttatataaatttgttttgtggaagttatttgaagttaggaagagatggagggtattttttaggagtgagatgagattttattatatttgattgtttagtattatttttgagtgaggggattaaaaaatttattttttaaattaggatatttttaagagtggaagggggatttattaatatttttatttggataagaggtaaatattagaatgttttcgatgaaggggatatataatggatttttttgatgtgaaatttgttagatgggttggaaagttcgtatattgggataagtatgatttgagttgtttgggataaggataggggtataagagaaggaaatgggtaaagagagaagtttgtatttagttaagggtgtagagatgttatatatgattgttttttagggaatcgggtttttagtttatattttagttgtttaattattttttttttgaattgattgttttttttttggaattttaggtttgattttattttttggtttttttagtttacgatttttttgattcgatttttttttttagaatttagtcgtttgaatttttagtttgtggtttttttttaggttttagttttttttgtttttgattgaaatagtagtattttttaagttttgggggttttttcgggttttagtttcgatttagaattcgttcgttgtttgttacgttgttattgtcgttttttttataaagggatttgagcgttcgggtttaggggtttcgtatagtaggtgaggtttttttgttttatttttttgggttgttcgtgtttcgtgttttggattatcgtttagtagtgttttgttttttgtttgggtttcggttttttttgtatttgttgtttggattttcggtttgtttgggtttgggttttggtgggtttggttttggtttttttttttgtttttgattttttatttgttagttttattgtttttgttatatattttttgtttttgttatggtttttttttgttttttttttgtttttttttgtttttttttgtttattttggggtttttttgattgtattttgtttttttttttgtcgatttttttttcgggggtcggggggtgttgttttttagggcgggaggtttgtttttcgtcgcgtgtttcgtttcgtttattgtttttttttttttttttttttttttgtaggttttttttatgatattatttgaacgttttttttttttaagggtgtgtggtattattttatattttttttttttggggttgttgttggttttgttgtttggggtttaggtgaggtagtaggagaatgggggttgttggggtggtttagttaaattttgagttttagagttttttttaattttgtttttttttaggggttttttggtgttggttttatatttttagttgtttagattgttcgttagtattttaagatgtattttgtttatagtaattttaaatttgttgtttattttattggtaaatatttatttgattttttagatatgtttttattagttttttttttatttttgttttaggaatttaagtatttattttttttttttaattttttttacgttaaaaaaaatagagggagtttatttttatgtttttttttgttattttttaggaatttagttgtttagtgtttatttttttagggattgagatttttgatttagatttttgattttttatttttattttttatggttttttttaggagattttagtaagtagaatttattgttttggagagtaaatacggatcgtgtttttttttaggatggtttttttttgagtaataatttttttttggtttttattagtggtatttatttcgtttatttttaggtggttttttttgggaaagtttatttttttaaggttattttttttttattttatttggtttatgaggtttagtttttttttttttagtattttttttatgtgtttttttttagtttttagaagatggtgtatttagggttgtaggaattttggttgtattcgatgtattacggggttgcgttttagtttatttagggagattagttatttatttatatagatggtattttttatttagtttttagttttagtattgttttttttggagttttcgttttgtagaatttggaaaaatttagaaagaaaaaataattgattttaagattttttttttattttgtttttattttgattattttaggggtcgttattattttttttttggttattttaatagtttaagttttttttgattaagttatcggagtttttaaagaaggaattttaggtattttaggggattatatttttttgaattatttttgatgtttgtttggttgaggattttaagtttgtttaggaatttttagtttaaagttgttggttttgtttattagttaggtggggtttagatttatatatagaggaagagtaggtatatggaggagtttgggggatgattagaggtagggaggggattatttatgaaggtaaaaaaattaaattatttatttatggaggatggagagaggggaataatagaagaatatttaaggagaaatagagataggtttaagagatgaagagtgagagggtatgcgtataaggttgattaagagagaaagaagtaggtatgagggattatagggttttagaaggtagggaaaggttttgaaagttagttgtcgattagagttttatacggaggtatttgtattttcgatgaagtttaataaattttttttttttgaaatgttgtttgtttgtgtgtgtgtgtttgggagtgagaattttttagtttatttaaggaatggagggagggatagagggtttaaagggagtaagagttgtggggagaataaaaggataagggtttagagagttttagggatatgtgatggatttattaggtgaggtcgttagattgttgtag

SEQ ID NO: 90 - DNA, 3037 bp, Artificial Sequence
  Chemically treated genomic DNA (Homo sapiens)
ttgtagtagtttggcggttttatttggtgagtttattatatatttttgaagttttttgagtttttatttttttgttttttttatagtttttgttttttttgagttttttgtttttttttttattttttagatagattgggaagtttttatttttagatatatatatataagtagatagtattttagagaaaagaggtttattgggttttatcgagggtgtagatgttttcgtgtggggttttggtcggtagttggtttttagagtttttttttgttttttggggttttgtgattttttatgtttattttttttttttttggttagttttgtgcgtatgtttttttattttttattttttgggtttgtttttgtttttttttggatgtttttttattatttttttttttttattttttataaataaataatttaatttttttgtttttataaatagttttttttttgtttttagttattttttaagtttttttatgtgtttgttttttttttgtgtgtggatttaggttttatttagttggtggataagattaatagttttgggttgggaatttttaggtaggtttgaaatttttagttagatagatattagggatggtttagggaggtgtggttttttgggatgtttagaattttttttttgaaagtttcggtgatttgattagggaagatttgagttgttggaatggttaaaggagaggtggtgacgatttttgaaatggttagaatggaggtagaatggggagaaggttttgaaattaattattttttttttttggatttttttaagttttatagagcgaaggttttaaagaagatagtattagggttgaggattaggtgggggatgttatttgtgtgggtggatagttggtttttttgggtgagttggaacgtagtttcgtggtatatcgagtgtagttagggtttttgtagttttggatatattattttttgggagttgaggagaggtatatggaaggggtattgggaggagaagagttggattttatgggttaggtagagtggggaggaggtggttttgggagagtaggtttttttagagaagattatttgggagtagacgaagtagatgttattggtggggattaggagagaattgttgtttaaggagaaattattttggaggaaggtacggttcgtgtttgttttttagagtagtgagttttgtttgttggggttttttaggaagagttataggggatgggggtgggagattaggggtttggattagaggttttaatttttgaggaagtgggtattgaataattgagtttttgggggatggtagggggaggtataggagtgggttttttttgttttttttagcgtgggggaagttgggggagaggggtggatgtttgggtttttgaggtaggggtaggaggagagttggtggggatatgtttgggaggttaggtggatgtttattaatgaggtgagtagtaggtttgaggttgttgtgggtaagatgtattttggggtgttgacgggtagtttgggtagttgaaggtgtgaggttaatattagggagtttttaggggagaatagagttgaggggggttttagggtttaaggtttggttgagttattttagtagtttttatttttttgttgttttatttgggttttaggtagtagaattagtagtagttttagaaggaggaggtgtagggtggtgttatatatttttgggaggaagagacgtttaggtggtgttatggggagaatttgtagagaaagagagagagagagagagatagtgagcggggcggggtacgcggcggaagatagatttttcgttttgggagatagtatttttcgattttcgagagagagatcgatagagaaggggataagatgtagttagagaaattttaaggtgagtagagggagatagagagagataggaagggaatagagaggaattatggtagaaatagagaatgtgtgatagagataatgagattgatagatggagagttagagatagagaaggaaattaaaattaaatttattaaggtttaggtttaggtaggtcggggatttaggtagtaggtgtaggagggatcgaggtttaggtagagggtaggatattgttgggcggtagtttaaagtacgaagtacgggtagtttaaggagatggggtaggagagttttatttgttgtgcggagtttttgggttcggacgtttaggtttttttatagaggaagcggtagtggtagcgtggtaggtagcgggcgggttttaggtcggggttggggttcggggaagtttttagggtttagaagatattgttgttttagttaaaggtaggaaaggttgaggtttaggagagaattataggttgggggtttaggcgattgagttttgggaaagggagtcgggttaggggaatcgtgggttgggagggttagggagtggggttaggtttagagttttaaagaagggatagttaatttagagaggaggtggttgagtagttggggtgtgagttggaggttcggttttttgaagagtaattatatataatatttttgtatttttggttgagtataggtttttttttttgtttattttttttttttgtatttttgtttttgttttaaataatttaaattatatttgttttagtatacggattttttagtttatttggtaggttttatattaagaaggtttattatatattttttttatcggggatattttggtgtttgttttttgtttaggtgaaaatattaatggattttttttttatttttgaaagtgttttagtttggaagataaattttttggtttttttatttagagatgatgttggatagttaagtatgatgaggttttattttatttttgaaggatgttttttatttttttttgattttaggtggtttttatagaatagatttatataattttaaataaatatatattttaggattaatgtggtagatattttttaaagttttttataaaggaagtttcgagaattt

SEQ ID NO: 91 - DNA, 1250 bp, Artificial Sequence
  Chemically treated genomic DNA (Homo sapiens)
tttttttcggacgtataggtatttttcgcgtttttttagttttcgtcgttttcgttatcgttttcgggtcgtcgcgtttcggtatatataggatttttgttgggtattaatagttttattatggggttggtttggggattaggcgttttgtttttgatgtatgtgtgtggtattaatcgtattttagagtttggcggagataatagcgtgtttgatatttttgaatttatcggggtcgttcgtaaggggtttgggcgtcgattggtgaagggtttcgatttttttagtttagtttttcgtatcgaggatgttaatttgattttttttgtgtttgatgataagttttaagatttggtggatgttgtgcgggtagaaaagggttttttttttttggtatttttgaggtagatgaagaagattcggggtacgttgttggttttggagcggaaagattattttggttaggtttttagcgtggtgtttaatggtaaggcgggtattttggattttagtttgatcgtttaaggaaagtagtacgtggtgtttgtggaagaagtttttttggtaatcggttagtggaagagtattattttgtttgtgtaggaagatagggtttagttgtatatcgattgtgaaaagatggagaatgttgagttggacgtttttatttaaagcgtttttattagagatttggttagtatcgttagatttcgtatcgtaaaggggggcgttaatgataatttttagggggtgttgtagaatgtgaggtttgtttttggaattatattagaagatatttttaggaataaaggttgttttagttttattagtgttttttttatttttgataataacgtggtgaatggttttagttttgttattcgtattaattatattggttataagataaaggatttgtaagttatttgcggtattttttgtgatgagttgtttagtatggttttggaatttaggggtttgcgtattattgtgattacgttgtaggatagtattcgtaaagtgattgaagagaataaagagttggttaatgagttgaggcggttttttttatgttattataacggagtttagtatagaaataacgaggaatggattgttgatagttgtattgagtgttattgttagaatttagttattatttgtaaaaaggtgttttgttttattatgttttgttttaatgttatagtttttgatggagaatgttgttttcgttgttggtttagatgtga

SEQ ID NO: 92 - DNA, 1250 bp, Artificial Sequence
  Chemically treated genomic DNA (Homo sapiens)
ttatatttaggttaatagcgaggatagtattttttattaggaattgtggtattggagtagggtatgatggggtaggatatttttttgtagatggtaattgagttttgatagtgatatttagtgtagttattaatagtttatttttcgttatttttgtattgaatttcgttgtgatagtataggggaggtcgttttagtttattggttaattttttgttttttttagttattttgcggatgttgttttgtagcgtggttataatggtgcgtaggtttttgagttttaggattatgttggatagtttattataggagatgtcgtagatggtttgtaagttttttgttttgtggttaatgtagttagtgcggatggtagggttggaattatttattacgttgttgttaagggtgaggaggatattggtagagttggagtagtttttgtttttgaggatgttttttggtgtggttttaaagataaattttatattttgtagtattttttggaaattgttattgacgtttttttttgcgatgcggagtttggcgatgttggttaggtttttggtgaagacgttttggatggggacgtttaatttagtattttttatttttttatagtcgatgtatagttgggttttgtttttttgtataaatagggtgatgtttttttattggtcggttgttaggagagttttttttatagatattacgtgttgttttttttggacggttaggttgaggtttagggtgttcgttttgttattggatattacgttgaagatttggttagagtggttttttcgttttagggttagtagcgtgtttcgggttttttttatttgttttagggatgttagaaggaggaaatttttttttgttcgtatagtatttattaggttttggaatttgttattaggtataggggggattaggttggtattttcgatgcggaaagttgggttggaagggtcggggttttttattagtcggcgtttagattttttgcgggcggtttcggtgagtttaaagatgttaaatacgttgttgttttcgttagattttggaatgcggttggtgttatatatatgtattaggaataggacgtttagtttttaggttagttttatggtggagttgttggtgtttagtagggattttgtgtgtatcggagcgcggcggttcgggagcggtggcgagggcggcgagggttggaggggcgcggggaatgtttgtgcgttcgggggggg

SEQ ID NO: 93 - DNA, 3107 bp, Artificial Sequence
  Chemically treated genomic DNA (Homo sapiens)
ttgtagtgaacggtgattatattattgtatattagtttggggatatagttagattttgttataaaaaagtaaaaataattggttagtgtatgaggggttcgtgttttttgtttgtttgtttgttgagatagagttttattttgtcgttagattggaatgtagtggtatattttcggtttattgtaatttttgttttttaggtttaagtaattatttgttttagttttttaagtagttgggattataggcgttcgtattacgttcggttaatttttttgtatttttagtagagacggggttttattattttggttaggttggttttgaatttttgattttatgatttattcgtttcggttttttaaagtgttgggattataggcgtgagtttttcgttcggttaggggcgcgcgtttttaaaatatgggagagggaattgtgttttataattattattaggtgtttcgatatcgggtgttacgtcgtttcgtttttgaggcgcggcggtttattttggtaggtcgaggcgggtggattatttgaggttaggagttcgagattagtttgataaatatggtgaaatttcgtttttattaaaaatataaaaaattagtcggacgtggtggcgtatgtttgtaattttagttatttgggaggttgaggtaggagaatcgtttgaattcgggaggcggaggttgcgatgagtcgagatcgcgttattgtattttagtttgggaaataagagcgaaattcgttttaagaaaaaaaaggaaagattttttttttttttttcgtcggaaatatttttttttaggacggcgcgtttgtgcggcgacgcgcgtttagttatttagtaatttcggcgttaagttattttaggtggagtttagtaataatagagttatcgcgttttttattaattagcgtcgatttcgttttcgtaggtttaattaattagtgtcggcgttgtaaggaagtttttagagttttcgaggaaggtttttttaatttaaatttattcgtttgataatttttttatatttttttaaagaaggaagagaagcgtatagaggagaagggaaataattttttaggagttttttttacggttatgaggaatttggggtttagttgaaaagtttaaattgtttttcgggaggttgggcgcggcgaattatttttagcggcgtacggagacggcgtttacgtgaggggtgataagtgacgtaatattcgttgtataaatttgttttcgttagttcggagtatttaggggcggttggttttgttgggtgagtttgtttgtgtttttgtgggtggacgtggttggtgattggtaggattttggtattcgttaataggtattggttcgtagtcgtaacgattttgggggggtgtgagaggggggaatgggtgaggttaaggtggaggttttttggggttgggtgggtcgttgaggggagggcgtgggggaggggagggcgaggtgacgcggcgttgggttttttcgggatagtgggttttgttgatttgaggggggcgagggcggttggcgcgcgcgggttgacggaaattaacggacgtttaatcgatcggcgattttgtcgagtttatttcgcggggaaggcggaaaagaggtagtttgtgtggtttttggaagtttttattttggaattttagtgtgagaaaggtgtttttttttgtgttttaatgggatttttatttcgcgagttttgtgggtttggttttgtttttagtttgtttaatatcgtgtttaggtttgaggtagattggagttcggtcgggggagtttgaatattcggaatagttagtggggaaagttgtggacgtttggtaagagagcgttttggatttttcgttgttgacgttgaaattttgaatgacgaatttcgtattaagtgatttagttttgtaaaattgaggggaggtttgcggaatattaacgtatttaaggtattttgaaggaatagttgttaattttgaagaatattaggtgtaaaagtaagaaatataatgattttgaggtgatacgtttatgttttatttttaaattaggttaaaatgtagattttcgtgaaaatttttatcggtaagattattatttttgaggtggagtttagtgatattatcgaaaatgtgaaggttaagatttaggataaggaaggtatttttttcgattagtagaggtttatttttgtaggtaagtagttggaagatggtcgtattttttttgattataatatttagaaggagtcgattttgtatttggttttgcgtttgagaggtggtatgtagattttcgtgaagattttgatcggtaagattattattttggaagtggagtttagtgatattatcgaaaatgtgaaggttaagatttaggataaagaaggtatttttttcgattagtagaggtttatttttgtaggtaagtagttggaagatggtcgtattttttttgattataatatttagaaggagtcgattttgtatttggttttgcgtttgagaggtggtatgtagattttcgtgaagattttgatcggtaagattattattttggaagtggagtttagtgatattatcgaaaatgtgaaggttaagatttaagataaagaaggtatttttttcgattagtagaggtttatttttgtaggtaagtagttggaagatggtcgtattttttttgattataatatttagaaggagtcgattttgtatttggttttgcgtttgaggggtggttgttaattttttagttatggtattcgtagtgtttagtgatggtattattttgtattatagttatttgttttaatttaagtttagaaattataagttttagtaatagttgaatttgtttaaaatgttaataaaggtttcgttgtatggtagtatatttggtgttttgttatgaaattttttagtgatgtgtgggtacgtttaaaattggtgaaaatgtttagggatttaattttgagattggtaatgtgtttaaagttaagttatttgattttggtatatatttgggtgggttgaggggtaagagttttttttgttgtttaagttattataagttaggattt

SEQ ID NO: 94 - DNA, 3107 bp, Artificial Sequence
  Chemically treated genomic DNA (Homo sapiens)
ggattttaatttgtaatgatttaaatagtaaagaaggtttttgttttttagtttatttaagtgtatattaaagttaagtgatttaattttgagtatattattaattttaaaattaaatttttaaatatttttattagttttaagcgtatttatatattattagagaattttatgataaaatattaagtatgttattatgtaacgaaatttttattaatattttgaataggtttagttattattgaaatttgtaatttttaaatttaagttggggtaaatggttatagtgtagagtaatgttattattgggtattgcgaatgttatgattgaagaattaatagttattttttaggcgtaggattaggtgtagggtcgattttttttggatgttgtagttagaaagagtgcggttattttttagttgtttgtttgtaaagatgagtttttgttggtcgggagggatgttttttttattttggattttggtttttatattttcgatggtgttattgggttttatttttagagtgatggttttgtcggttagggtttttacgaagatttgtatattattttttagacgtaggattaggtgtagggtcgattttttttggatgttgtagttagaaagagtgcggttattttttagttgtttgtttgtaaagatgagtttttgttggtcgggagggatgttttttttattttggattttggtttttatattttcgatggtgttattgggttttatttttagggtgatggttttgtcggttagggtttttacgaagatttgtatattattttttagacgtaggattaggtgtagggtcgattttttttggatgttgtagttagaaagagtacggttattttttagttgtttgtttgtaaagatgagtttttgttggtcggggggaatgttttttttattttggattttggtttttatattttcgatggtgttattgggttttattttaagggtgatggttttgtcggtaagggtttttacgaagatttgtattttgatttagtttaaaagtaaaatataagcgtgttattttaggattattgtattttttgtttttatatttaatattttttaaaattagtaattatttttttaaaatgttttaaatacgttaatatttcgtaagtttttttttaattttataaggttaagttatttaatacgaaattcgttatttaaggttttaacgttaatagcggaaaatttagagcgtttttttattaagcgtttatagttttttttattaattgtttcggatatttaaattttttcgatcgaattttaatttgttttaaatttaagtacggtgttaggtaaattgaaaataaaattaaatttataagattcgcgaaataaaaattttattgaaatataagaaggggtattttttttatattgggattttaaagtaaaggtttttagaaattatataaattatttttttttcgtttttttcgcgaagtaaattcgatagaatcgtcgatcggttaggcgttcgttagttttcgttaattcgcgcgcgttaatcgttttcgttttttttaggttaataaggtttattgtttcggaaaggtttagcgtcgcgttatttcgttttttttttttttacgttttttttttagcggtttatttaattttaagaagtttttattttgattttatttattttttttttttatatttttttaaggtcgttacggttgcgggttagtatttgttagcggatattaggattttgttaattattaattacgtttatttatagggatataaataagtttatttaataaagttaatcgtttttaaatgtttcgggttggcggaggtaaatttatgtaacgagtgttgcgttatttattattttttacgtagacgtcgttttcgtgcgtcgttgaaagtagttcgtcgcgtttaatttttcgagaggtagtttaggttttttaattgagttttaaattttttatagtcgtaagaaaggtttttaaaaaattatttttttttttttttatgcgttttttttttttttttaggaaaatataagaaaattattaggcggatgaatttgagttgaagaaatttttttcgaaagttttggaaatttttttgtagcgtcggtattgattggttaggtttgcgaaggcgaggtcggcgttgattggtgggggacgcggtggttttgttgttgttgggttttatttggggtggtttagcgtcgaggttgttaagtaattgagcgcgcgtcgtcgtataggcgcgtcgttttgaaagagggtattttcggcgggagaaggagggggggttttttttttttttttttgagacggatttcgtttttgttttttaggttggagtgtaatggcgcgatttcggtttatcgtaattttcgtttttcgggtttaagcgatttttttgttttagttttttaagtagttgggattataggtatgcgttattacgttcggttaattttttgtatttttagtagagacggggttttattatgtttgttaggttggtttcgaatttttgattttaggtaatttattcgtttcggtttgttaaagtgggtcgtcgcgttttagaagcgggacggcgtggtattcgatatcgagatatttgatggtgattgtgaagtataatttttttttttatgttttaaaaacgcgcgtttttggtcgggcgggaggtttacgtttgtaattttagtattttgggaggtcgaggcgggtggattatgaggttaggggtttaagattagtttggttaaggtggtgaaatttcgtttttattaaaaatataaaaaaattagtcgggcgtggtgcgggcgtttgtaattttagttatttgggaggttgaggtagataattgtttgaatttaggaggtagagattgtagtgggtcgagaatgtgttattgtattttagtttggcgatagagtgagattttgttttaataaatagataaataaaaaatacgagttttttatatattggttagttgtttttgtttttttgtgataaagtttggttgtgtttttaggttggtgtgtagtggtgtgattatcgtttattgtag

SEQ ID NO: 95 - DNA, 4001 bp, Artificial Sequence
  Chemically treated genomic DNA (Homo sapiens)
tatggaaagtgtaaatagtgttcggtgtaaagtaggagttgtgataagtggatttttttttagaaatgggatttcgggttaggagtagtggtttacgtttgtaattttattattttgggaggttaaggtgggtggatcgtttgaggttaggagttcgagattagtttggttaatatggtgaaattttgtttttattaaaaatataaaaattaggtacgtgtgatggtgtatgtttgtaattttagttattcgggaggttgaggtaggagaatcgtttgaattcgggaggtgaaggttgtagtgagttgaaattttgttattgtatcgtagtttgggcgataagagtaaaattttatttgaaaaaaaaaaaaaggaaagaaagaaggaaagagaaggaaagaaagaaggaaagagaaaggaaggaaagaaagaaagaggaaaaaaggaaaggaaaaggaaaaagaaaagaaagaaaaggaaggaaagggagaaatgggatgtttgttaggtgtagcgttttggggaggcgtggagagtttataatagggattaaggtgttttttagtcgtagaatatggattatttgttaggtgtggttttggtatatttaggttattggttttgtcgatttgttaaatttaattatttgggtattttttcggttaatatagaggatgtttttatgtgaatacgtgtttatttgtgaaatgtttataatgttaaaggttcgttttggggtaaatatttgatagcgtttggtaaatttaataaatgttttttttgtaatgagtaagttttttaatgtttaaagaaatagttgaattcgttagtaatatgtcggatgttttttttatgtttgtatattttttcgttagtttttttttttttttttttttgagacggagtttcgtttttgttgtttaggttagagtgtaatggtgttatttcgttttatcgtaatttttatttttcgggtttaagcgagttttttgttttaacgttttgagtagttgggattataggtatgtgttattacgtttggttaattttgtatttttagtagagacggggtttttttatgttggttaggttggtttcgaattttcgattttaggtgattcgttcgtttcggttttttaaagtgttgggattatcggcgtgagttatcgcgttcggttcgttagttttaatatttatgttttttggagggtgaagggtttgaaaggtattaaaaattttggtttttaggagcgagttaaatttttttttttagagattgaaggaggttattcgatttcgtttttaggaaaatttaattcgtaatttttttttcgttttggtttttttaggttttattattcgcgtcggggagacgcggttcggtttacgttaggtcggtaagaatttattaggttttaggagggcggggtcgagttttagaagtcggggttcgggttaggagttttggtgtaggcggattcgggcgcgtgttatgggattataattttcggtacgtatcgcggattgcgtcgaatacggttggttgggagatttaattttattgtttttatcggttaatgggacggaggaaagaggtttgattcggattttcggaggttaatggtaatatagaggaggcgggtgtttttttattatttattttgcgtttagagaagttatatttaaaaggtcgtgtcgggtcgggttttcgtaggtagtgggattagagtcgggaggggcggcggtgtttcgggaaagcggtttttggggtattcgggttttttcgaggcgggtttcggacgtcgtcgtgggcggggtcgagggcggggtttggtttcgttgtggagcggttcgtaatttattatggcggtcgcggggtttggtgtttgtgtttgagtagcgttggagtcggagtcggttttcgggttttgcggttgaggagttttttcgttgtttacggtttttatcggcggggggcggttgggtttttcggcggagttcgggagatgtgattgtttgagggcggtggtggtgttagcgttcggggtcgggggagggggtgtttcgggtagagattttcgggtttggggtagttgaggcggtcgggttttttttatacggggttcgtttttcgttgtttgggtcgcgagagtttttcgttttttatagtttcgtttcggttttgggatattgcgggtggtttgttttttttagtttgggatatttcgttttttgaggcgtggaagagcgtcgtttcggagtaagttgttcgtgtcgcgtttcgatagttttttttagttttaagtcgttttttatttcggatttcggttttaattttggttacggagttttttatttaaattttttttttgttgttaaggggttttttttttttttaaggtggttttcgcgagtttttaatgttttgattttttttaatgttatttacggtttttttagttttagtttagttaaaaattttaatgtaaaggaaaagtttggattggttttataggttttttaaaaagcggatttaaaagttgttggtaatgtattttttttcgttagagtcgagggtaaattcgttgaaatttgggtgattcgtgttttttttcggagagtaaagtagagaagcgagagcggttattagttcggtaggaaatttgttggaagatgaagaagttaagatagggggttggtgatttttataggaaaagttttggaggagtagttaaagattattagcgttttttttatgtgtgagaattgaaatgattagtattattgattttttttagtattttttgtgaatatttttgtttaggtttttttttttgaaaagaaattgttatttagttcgtttaaaataaattaagaaatttttgggtaatattgtaattatatgaaattgataatcgcgaaaataattggaatttttgtttgtaagtgttaatttaaaaaaagtgtttttttttgttatggaagatgtttttttgtgattgattttaattgttgatttgtggagatgtagcgaatgtgaaattttacgtatatgttatttttttttacgttcgttgatcgttttggaagattttgaatttttttttggaaaggggtatttattattattttatggggtagtagtttggaaaagtatttggggattaaagaaggttaagtttgtttgttttgtattttattaaaggagtagggaagaaggaattatcgaggtatgggggtttatattgtaatgtttttgtggaatatggtgagtgttttttaaaatttttgtttatggttttttttatgtatttattttaggtttttaaggaattttgaataatagtatttgcgatagttttttttaattttatttaataaatttgttattgtagttattttttagtggaattttttttgtataagaaaaagttatttcgtgatttcggttttatttaaaatttatttgagttgtttattttttgtttgatttttttgttaatttattgttgattttggataagttattttattgttttagggttttagttttttgaggggttggattttagtggttttttagggtttttggttttatgattttgttttaatcgaagtcgtgggtttttttgataagtatggattttttattgttttgtttatagagagtttttattatatttttaaagtggtttgtgtttttgagaaagttaagaattatagatattggttgacgttaatatttttgattttttttttcgtaagtaggatttgaaaatatttattttggagttatgtgggaaaaattaagtggggaagtagtattttttgtgaattttagatagatagtttttgttttattttttataaggagtaatttttttttcgttgatgaagtttttattttgttttttttttgtttagaatgatatttgggttaataaaggttatttgtgatatttttatgaatatatttggtatttgaatgttgttcgtatatt

SEQ ID NO: 96 - DNA, 4001 bp, Artificial Sequence
  Chemically treated genomic DNA (Homo sapiens)
aatgtacgggtagtatttaaatgttaaatatgtttataaaaatgttatagataatttttattggtttaaatattattttaaatagggagaagataggatgaaagttttattaacgaggaagagattattttttatggaaggtaagatagaagttgtttatttaaaatttataaggaatgttgtttttttatttgattttttttatatggttttaaagtgagtatttttaagttttatttacgaaggaaaaggttaaggatattagcgttaattagtatttatgatttttaatttttttaggaatataaattattttgagaatatgataaaagttttttgtagataaagtagtaaagaatttatgtttgttagaagagtttacgatttcggttagagtagaattatagaattagggattttaagaaattattgaagtttagttttttaggaaattaaagttttggaatagtaaagtggtttgtttaaggttaatagtgaattagtagaggaattaggtaagaaataagtaatttaaatagattttgaataaagtcgaagttacgaagtaatttttttttatataaagaaagttttattaagagataattatagtaataaatttattaagtggaattggaaggaattgtcgtaagtattgttgtttaaagttttttgaaggtttaagatgaatgtatgaggaaaattatgagtagaaattttgaaaagtatttattatgttttataaaaatattgtagtgtggatttttatgtttcgatgatttttttttttttgtttttttgataaaatgtagggtaggtaagtttggttttttttggtttttaagtatttttttaggttgttgttttataaagtaataataggtatttttttttagaagagggtttaagattttttagaacggttagcgagcgtagagggaaatggtatatacgtgggattttatattcgttgtatttttataagttagtaattgaagttaattatagaaagatattttttataataaaaggaagtattttttttaggttgatatttgtaagtaggagttttaattattttcgcggttattaattttatgtaattgtaatgttatttaaaagttttttgatttgttttaaacgggttgaataataatttttttttaagaagaaaaatttaaatagaaatatttataggggatgttgaaaagggttaataatgttagttattttaatttttatatataaaggaaacgttgatggtttttggttatttttttagaattttttttgtggaagttattaattttttattttagtttttttattttttaataaattttttgtcgaattagtggtcgttttcgtttttttgttttgtttttcggaaaaggatacgggttatttagattttagcgagtttgttttcgattttgacgaaaaggaatgtattgttagtaatttttaagttcgttttttaaaaggtttgtggaattaatttagattttttttttgtattaaagtttttggttgagttgagattaagggggtcgtaggtgatattggaagaagttagggtattagaggttcgcgggagttattttgggggaaggggagattttttgatagtaagggagggatttgaatgggaggtttcgtggttaaagttggggtcgggattcggaataaggggcggtttggggttgagggaagttgtcggggcgcggtacgggtagtttatttcggggcgacgtttttttacgttttagaaaacggggtgttttaagttgggggaaatagattattcgtagtgttttaaagtcggggcggggttgtaagggacgaaggattttcgcggtttagatagcggaaggcgggtttcgtgtagaggaggttcggtcgttttagttgttttaagttcgggggtttttgttcgagatattttttttttcggtttcggacgttgatattattatcgtttttaggtagttatatttttcgagtttcgtcgagggatttagtcgtttttcgtcggtaggggtcgtggatagcggaggggttttttagtcgtaggattcgggaatcggtttcggttttagcgttgtttaggtatagatattaaatttcgcggtcgttatgatggattacgagtcgttttataacgaggttaggtttcgttttcggtttcgtttacggcgacgttcggagttcgtttcgaggggattcggatgttttaagagtcgttttttcgggatatcgtcgtttttttcggttttggttttattgtttgcgaaagttcggttcggtacgattttttaaatgtggtttttttgagcgtaaggtgagtggtaaggaagtattcgttttttttgtattgttattggttttcgagaattcgggttaggtttttttttttcgttttattggtcggtgggagtagtagggttggattttttagttaatcgtgttcggcgtagttcgcggtgcgtgtcgggagttgtggttttatggtacgcgttcgagttcgtttgtattaagatttttggttcgggtttcgatttttggggttcggtttcgtttttttgggatttggtagatttttgtcggtttagcgtaggtcggatcgcgttttttcggcgcgagtagtgagatttggaagagttaaagcgagggaaaaattgcggattggatttttttggaagcggagtcggataattttttttagtttttaagggagaaaatttggttcgtttttagaaattaaggtttttgatgttttttaagttttttattttttaaaaagtataaatattagaattagcgggtcgggcgcggtggtttacgtcggtaattttagtattttgggaggtcgagacgggcggattatttgaggtcgggagttcgagattagtttgattaatatggagaaatttcgtttttattaaaaatataaaattagttaagcgtggtggtatatgtttgtaattttagttatttaggacgttgaggtaggagattcgtttgaattcgggaggtagaggttgcggtgaggcgagatggtattattgtattttagtttgggtaataagagcgaaatttcgttttaaaaagaaaaaaaaaaaaaaattagcgaagaaatatatagatatagggaaaatattcgatatgttgttaacgaatttaattgtttttttgggtattaggaggtttatttattatagaaaaggtatttgttgggtttgttaggcgttattagatgtttgttttagaacgaatttttaatattataaatattttataggtggatacgtgtttatatgaaaatattttttatattagtcgagaaaatgtttagatggttgggtttagtaagtcggtagaattaatgatttagatgtgttaaagttatatttaataaataatttatgttttgcgattaaaaagtattttggtttttattataggttttttacgtttttttagagcgttgtatttgataggtattttatttttttttttttttttttttttttttttttttttttttttttttttttttttttttttttttttttttttttttttttttttttttttttttttttttttttttttttttttttttttttttttttttttttttagatggagttttgtttttgtcgtttaggttgcgatgtagtaataggattttagtttattgtaatttttatttttcggatttaagcgatttttttgttttagtttttcgagtagttgggattataggtatatattattatacgtgtttaatttttgtatttttagtagagatagggttttattatgttggttaggttggtttcgaatttttgattttaagcgatttatttattttggttttttaaagtggtgggattataggcgtgagttattgtttttggttcgagattttatttttaaggagggatttatttattatagtttttattttatatcgagtattgtttatattttttata

SEQ ID NO: 97 - DNA, 4501 bp, Artificial Sequence
  Chemically treated genomic DNA (Homo sapiens)
ttagggagtaaataaattatgtgtggggttgggtaattagttgagtcgaagcgtaaataaaatgtgaatatacgtttgcgggttatatatagtgtatttttattagtatttagaaaaaattgtgagttagtgaattaggaaattaatgtttggaaggtagttaaattttaattagtttaagatttttttttttttttaaaaaaaggtacggaagtaatatttttttttttttttttgattagaatcgatgtattttttgtgtatgatcgtatttttaataataaaaggggaaagaggatttggaaaggaattaaacgttcggtttgttcggggaggaaagagttaacggttttttttataagggtttttgttgattttttcggttcggtttataagttttttatttgttttttttaggaagttcggtttcgcggttcgggtattttttgttttttttatattttttcgtttagtatttttgattttttttaaattcggtagttcgagattgttgtaaatcggcgttatagggcgtaaaggggatttgttttttttgaaatttggttgagaaattgggaatttcgtgtgggaggcgtgggggtgggacggtggggtatagattggtagagagtaggtaatttttttttcgttttagtttagttttggaataggtagatatattttagggttaaatagacgtttttcgtacggggttttacggaagtttgagtaggcggggtaggaggggcggtatttgttgttttggtagtaaattgggggatttagtttgggtggaaggtatttaatttagatagttgtgtatatataatgtataatatatgattttttttaataaatgtaatgggagtttatttataacgcgttttttaagtatacgtggtaatgcgttgttgggttattttaattattttaggtatcgtttttttttttatgtttttattatttttttttatttatattaatattttacgttttgaacgcgcgtttattaatattttttttttttttattttttttgggatttttgattaaagcgcggttttttttttagttttagcgaggcgttttgtagtttggtacgcgcgtggcgtggcggtgggcgcgtagtgcgttttttgtgtggagggtagttgtttcgtttgcgatgatttatatttataggataaggatgcggtttgttaaatagtattgttacggaggagtagtagagaaagggagagggtttgagagggagtaaaagaaaatggtaggcgcgcgtagttaatttatgcggtttttttattttgtttatattttagagttagagtgttcggttgttcggttgagttttttttttattttttttattttttttattttttttataagcgtttttttcgggtttttaaagtagagggcgtgggggaaaagaaaaaagattttttttcgttaattttcgtttatcggttttttataatgcgagggtttggacggttgaggattttcgagttgtgttgttcgcggtcgttatcgtcgggtttcggtcgtttttggttttttttttgtttcgagaagggtagggttttttagaggtttggcgggaaaaagaacggagggagggatcgcgttgagtataaaagtcggttttcggggttttatttaattcgttgtagtaattttagcgagaggtagagggagcgagcgggcggtcggttagggtggaagagtcgggcgagtagagttgcgttgcgggcgttttgggaagggagattcggagcgaatagggggtttcgtttttggtttagttttttcgttgattttttagttagcggttcgtaatttttgtcgtatttacgaaattttgtttatagtagcgggcgggtattttgtattggaatttataatattcgagtaaggacgcgattttttcgacgcggggaggttattttgtttatttggggatattttttcgtcgttgttaggattcgtttttttgaaaggttttttttgtagttgtttagacgttggatttttttcgggtagtggaaaattaggtaagtatcgaagtttatttgttttttaatttatttttttattattttaatgttgagatgagtcgaatgtttaaatagggtgtttttttttttatttttgcgttattgatattttttttagagtagttatggtaattggggttggggtggggggtaatttagaattggatcggggtaaagtgatttgttaagatgggagaggagaaggtagagggaaaacgggaatggtttttaagattattttttcgagatttttgttttatgaatatatttacgttgattttcggtcggtcggatatttttgttttattgtgttaattgttttttgggttttggggggttgggggttgttttgcggtgggtagaaagttttttgtattttgagttttttggagtagggatcgtatatcgtttgtgtgagttagatcgtttcgtagtcgttgatttgttttcgttttcgggagggtatttaaatttcggtttatcgtatttttgatagtcggagacggatattgcggcgcgtttcgttcgtttgttttcgcggcgattttaattcgttttgatttttttaagaagttggtatttggttttttaaaaagtaataatataatttaaaatttgggtttttagaggtgttaggacgtggtgttgggtaggcgtaggtaggggaaaagggaggcgaggatgtgttcgatttttttggaatcgttgatttggaaaaattagggcgaattttcgtatttagttttgatttttttgtcgcggtcgttttcgggtgttttcgcgttcgagatgcggaggaattgcgaggagcggggttttgggcggttttagaatagttgttatttttggtggggtggtttcgggggaggtatcgtagcggggtttttggcgtagttgtattttcgtattgagtgcgaagggaggtgtttttattattatttgatattttttttgtatttatggaggggtgttaaagttcgcggttgagttcgttattttagtcggcgagagaaagaagaaaagttggtaaaaggagtgttggacgggggcggtattgggggtggggacgggggcggtggagagggaaggttgggaggggttgcggtgtcggcgggggtaggagagcggttagggcgcgagtgggaatagtcgtagcggaggggtttcggcgcggagcggggtttacgtagtcgttagcgtttaggcgtttttcgtttttttttttaggtggcgtaaaattttgtgttttggattttggtaaattgttttttttatcgttatttttcgcggttttttaagggcgttagggtcgatttcgatttttttgtcgttgcggggtcgattttcgggttttgcgtttcgggttttcgggggagcgggggttcggcgggtattaagtcgttggtttattaagtgcgttttcgagatagtaggggattgtttaaagggggtgaaagggtgttttttttatttttttattaagattatttagtcgttttaggggatagttttgtaaggggagaggttcgggattgtggcgcgtattgcgcgttgcgttaggttttcgtattaagatttttttaatttaagattgtttttcgttttgtgtgtttcgttttagtagtttttcgcgacgatgttttttaacgttagttttattaataggaattatgatttcgattacgattcggtgtagtcgtatttttattgcgacgaggaggagaatttttattagtagtagtagtagagcgagttgtagttttcggcgtttagcgaggatatttggaagaaattcgagttgttgtttatttcgtttttgttttttagtcgtcgtttcgggttttgttcgtttttttacgttgcggttatattttttttttttcggggagataacgacggcggtggcgggagtttttttacggtcgattagttggagatggtgatcgagttgttgggaggagatatggtgaattagagttttatttgcgattcggacgacgagatttttattaaaaatattattatttaggattgtatgtggagcggtttttcggtcgtcgttaagttcgttttagagaagttggttttttattaggttgcgcgtaaagatagcggtagttcgaatttcgttcgcggttatagcgtttgttttatttttagtttgtatttgtaggatttgagcgtcgtcgttttagagtgtatcgatttttcggtggtttttttttatttttttaacgatagtagttcgtttaagttttgcgtttcgtaagattttagcgtttttttttcgttttcggattttttgtttttttcgacggagtttttttcgtagggtagtttcgagtttttggtgttttatgaggagatatcgtttattattagtagcgattttggtaagcgaagttcgtttaggtttgttaaaagtgggcggttggatatttttt

SEQ ID NO: 98 - DNA, 4501 bp, Artificial Sequence
  Chemically treated genomic DNA (Homo sapiens)
gaaaggtatttagtcgtttatttttgataggtttgggcgggtttcgtttattagagtcgttgttggtggtgggcggtgtttttttatggagtattaggggttcggggttgttttgcggggaggatttcgtcgaggagagtagagaattcgaggacggagagaaggcgttggagttttgcgaggcgtaggatttgggcgagttgttgtcgttgagagggtaggggaagattatcgaggggtcgatgtattttgaggcggcggcgtttagattttgtaggtataagttggaggtggagtagacgttgtggtcgcgggcggggttcgggttgtcgttgtttttgcgcgtagtttggtaggaggttagtttttttgagacgagtttggcggcggtcgagaagtcgttttatatatagttttggatgatgatgtttttgatgaaggtttcgtcgttcgggtcgtagatgaaattttggtttattatgtttttttttagtagttcggttattatttttagttggtcggtcgtggagaagttttcgttatcgtcgtcgttgttttttcgaagggagaagggtgtgatcgtaacgtaggagggcgagtagagttcggagcggcggttaggggataggggcggggtgggtagtagttcgaattttttttagatattttcgttgggcgtcgggggttgtagttcgttttgttgttgttgttggtagaagttttttttttcgtcgtagtagaaatacggttgtatcgagtcgtagtcgaggttatagtttttgttggtgaagttaacgttgaggggtatcgtcgcgggaggttgttggagcggggtatataaagcgggaggtagttttgagttaaaggggttttggtgcggaaatttggcgtagcgcgtagtgcgcgttatagtttcgaatttttttttttgtagagttattttttaaagcggttgggtggttttggtgggggaataaagggagtatttttttattttttttggatagttttttgttatttcggagacgtatttagtgaattagcggtttggtgttcgtcgagttttcgttttttcgggagttcggagcgtaaagttcgggagtcggtttcgtagcggtagaggaatcgaaatcggttttggcgtttttaagaagtcgcgggaggtggcggtgaggaaaataatttgttaaaatttaaggtataaagttttgcgttatttgaaggagaaggcgagaggcgtttgggcgttagcggttgcgtgaatttcgtttcgcgtcggggttttttcgttgcggttgtttttattcgcgttttagtcgtttttttattttcgtcggtatcgtagttttttttaattttttttttttatcgttttcgtttttatttttagtatcgttttcgtttaatattttttttgttagttttttttttttttttcgtcggttggagtggcgagtttagtcgcgggttttaatatttttttataaatataaggggggtgttaaataataataggggtattttttttcgtatttaatacggagatgtaattgcgttagagatttcgttgcgatatttttttcggagttattttattaagggtagtagttgttttggaatcgtttagagtttcgtttttcgtagttttttcgtatttcgggcgcgaggatattcgagggcggtcgcggtaggggagttagggttgggtgcggagattcgttttggtttttttaagttaacgattttaggagaatcggatatattttcgtttttttttttttttgtttgcgtttatttaatattacgttttaatatttttagagatttaggttttaaattgtattattgttttttaaaaagttaaatgttaattttttaaaaggattagggcgggttggaatcgtcgcggggataggcgggcgggacgcgtcgtagtgttcgttttcggttgttagaaatgcggtgagtcgaaatttaaatgttttttcggagacggggataagttagcggttgcggagcgatttggtttatataggcgatatgcggtttttattttaaggagtttaggatgtaaggggttttttgtttatcgtaaagtaatttttagttttttaaaatttagagagtaattaatataataaagtaggaatgttcgatcggtcgggagttagcgtgaatatatttataaggtagaaatttcgaaagggtagttttaaaaattattttcgttttttttttgttttttttttttttattttgataagttattttatttcgatttagttttggattattttttattttagttttagttattataattattttgagaaaagtgttaatagcgtaggaatgggagaaaagatattttatttaggtattcgatttattttagtattaaagtgataaaaaaataaattaaaaggtaagtggatttcggtgtttatttggttttttattattcgaaaaaaatttagcgtttaagtagttgtaaggagagttttttagagaagcgggttttggtagcggcggggaagtgtttttaaatgggtagaatagttttttcgcgtcgggagagtcgcgtttttgttcgggtgttgtaagttttagtgtaaagtgttcgttcgttgttatgggtaaagtttcgtggatgcggtaagggttgcggatcgttggttgggggattagcgggagggttgggttagaggcgaagttttttattcgtttcggatttttttttttaggacgttcgtagcgtagttttgttcgttcggtttttttattttagtcggtcgttcgttcgttttttttgtttttcgttggaattattatagcgagttagataaagtttcgaaaatcggtttttatatttagcgcgattttttttttcgttttttttttcgttaagtttttgagaagttttgtttttttcgaggtaggaggggagttagggacggtcggggttcggcggtggcggtcgcgagtagtatagttcgggggtttttagtcgtttagattttcgtattataaagggtcggtgggcggagattagcgagagaggattttttttttttttttttacgttttttgttttgggaattcgggaggggcgtttatggggagggtggggagggtggggaaggtggggaggagatttagtcgggtagtcgagtattttagttttaggatgtaaatagagtaagagagtcgtatgaattaattacgcgcgtttattatttttttttgtttttttttaaattttttttttttttttgttgttttttcgtagtagtattgtttgataaatcgtatttttgttttgtgagtataaattatcgtaggcggaatagttgttttttatatagagaacgtattgcgcgtttatcgttacgttacgcgcgtattaggttgtagggcgtttcgttaaggttggggaaagggtcgcgttttgattaagagttttagggagagtggaggaaagaagggtattaatgggcgcgcgtttagagcgtgggatgttagtgtagatagggaggaatgatagaggtataaggaggaaaacgatgtttagaatgattaaaataatttagtaacgtattgttacgtatatttggagagcgcgttatgaataaatttttattgtatttgttggggggagttatgtattatgtattatgtatgtatagttatttggattggatattttttatttagattgagttttttaatttgttgttaaagtagtagatatcgttttttttgtttcgtttgtttaggttttcgtggggtttcgtgcgggaggcgtttgtttagttttgagatgtgtttgtttgttttagagttgggttagggcgagagggaggttgtttgttttttgttagtttgtattttatcgttttatttttacgttttttatacggagtttttaattttttagttaggttttagaagagataaattttttttgcgttttgtggcgtcggtttgtaatagtttcgggttgtcgggtttgggagaaattaaaggtgttagacgggagaatatgggaggggtagggggtattcgaatcgcgggatcggattttttaaaaggggtaagtggagagtttgtggatcgagtcgggggagttagtagagatttttgtgaaaaaaatcgttaattttttttttttcggataaatcggacgtttaatttttttttaggttttttttttttttttattattggaaatgcggttatgtataaaaaatgtatcgattttgattaaagaagaggagaggagtattattttcgtgtttttttttgggggggggggggagttttgagttaattaaaatttggttgttttttaggtattaattttttagtttattgatttataattttttttgaatattagtgaaagtgtattgtatgtaattcgtaaacgtgtatttatattttatttacgtttcgatttagttagttgtttagttttatatatgatttgtttgttttttga

SEQ ID NO: 99 - DNA, 4501 bp, Artificial Sequence
  Chemically treated genomic DNA (Homo sapiens)
aagttgttttaggtgtagaaattataaagtaagtaggagtaggtttttgtttttaagatgttttatatgtagtatagatttaacgtatttaaaacggaaggttgttattttttttgtttttttaatttatataataatatatattcgtgttttatgttttaattatattgaattgtttgttttttttattttcgtttgttaatagtgagtagtttggtgtttttagattataggggtgggagggaaagagagagatagtagataattaggttggggtagatagatattagattttgatgttaggtggaggaatttagatgtattggttgttgttttaagttatttttttttggtttaaattttagattggtcgtatagtttaatttttttttttttattaaaggttatttgtgtagaagatgatataaagggggatttagtacggtgattcgtgtttgtaatttttgtattttcggaggttaaggagggaggattatttgagtttaggagttcgaggttgtagcgagttatgatcgagttattgtattttagttttgacgttgagtgagattttgttttttaataaaatatatttaaaatttaaaaagaagattatataaaggggttatttattattttggttagtaatgtagggtaaaatttgaaataatttggttttgtagtattttttagatgttaaatttttattttttattgtatagtttttatagtgttttgtgtgagatgagagggagtatggcgggttttagttggttttgttttgggaaaaattttttatttttgtatcgtttttttaaagcgggggttaagttagcgtcgtttgtttttttatttagattagattttttttttagatgtttttatttttttgaagttttataataattttgtgaggtaagtattattatttttttattttatagatgaaattgaagtttaggaaggttacgtttcgggttttaaatttcggaattttcgtttcgatgttatttaggtttgggttattgagtttaagaaacgggtcgacgggtgattagacggacgtcgggattagtttaagtttagggttgagggtcgttaggtggcgcgtttttttttttttatttttcgcggcggttcgggcgtatttgaatttagcggggtgcgtcggggaaagtaggcgcgtagggtggggcggggagtagttttaattttttagttcggagtgggtaaggagtacggtttagtttagtcggttggtatcgttaagcggtcgtcgggtcgtattagttttttttttgtttgcgttttttagcgtgtaatttatttggggggttatcggggattgaacggagcgggcgagcgttgttaggaggtggggtcggttttatttgtcgattgttcgtagtaggtagggagagggcggggtttgttttatagggttcgttttttagtttttgggtttcgggcgcgcgacgagatataaggtagttaggaaataatgcgtttgtagttcgcgttttcgcgtcgatttcgagagcgttcgggtcgtcgtgcgcgagcgagggagggcgcgcgcgcggggggggcgcgtttgtgagtgcgggtcgcgttttcggcggcgcgtatgtgcgtgtgtgttggttgtcgggttgtttcgagtcggcggggagtcggttcgttttaggtggcgggcggttggagcgaggtgaggttgcgggtggttagggtacgggcgcgggtttcgcggtgcgggttggttgtaggttgttttttgggtacggcgcgttttcgttcggtttcgtcgggttttgggagttgcgtttcgggcggcgttggtaaagtttgttttgaattcgttgtttatagtcgggttcgcgcgttgcgattggttttttttattattttgattcggggttcggtttttcgggacgcgaggattgggcgtaggttgtaagttggtggggttggggaggaacgagagttcggtagtcgattgtgtcgagggattcggggatatttttttcgttcggtcggtattcggttagtacgtttttttttttttttcgtagggagcggatatggattacgattcgtattagtattatttttacgattatgattgcggggaggatttttatcgttttacggcgtttagcgaggatatttggaagaaattcgagttggtgttatcgttttttacgtcgtcgttttggggtttgggtttcggcgtaggggattcggttttcgggattggtttttcggagtcgtggttcggagggtgtatcggagacgaagcggaatttcggggttattcgaaaggttggggtaggaattacgtttttattatacgtcgtgattgtatgtggagcggtttttcggttcgggaacggttggagagagttgtgagcgatcggttcgtttttggcgcgtttcgggggaattcgtttaaggcgttcgtcgtttcggattgtatttttagtttcgaagtcggtaattcggcgttcgtcgttttttgttcgttgggcgaatttaagatttaggtttgtttcgggttcgagagtttaagcgattcgggtaaggattttttcgagttatttaagagggggttattttatgggtggttaaagttttgtttttgtttgaggttaggtattggttttttttaagtttttgggttattttcgtttttttttggttgaagttgttcgtgtagtttttaatcgtgtttgtttggtacgtgggtgtgttggtaaatagtttggaaaagtggcgtgggagttagtttttttttgatgattattggagttttaggggataagggatttgaggtgagggttggcgtttagagaggataatattggggttggattgtaagggattgaagggggtattttaagagatattttaaatttgaagtttttttgttgttgtttttttttttaggaaatttatatttttttagggggagaagaagtcgagagttttttgtgtaaagttaaaattttcgtttttttaaaaatttaggtttttagttggttttattttaaaatgttaataataaatgtttttttttcgtgtttttttattattatttattattcgtgtatttttgagatagggagggaagaatgaatattttttattaatagatggaaaaattgaggtttagagatagataattattataagttagttttagttttttgttatttagttagttttttttttttaatgttttattttaattaggtattttttttttgatgtttggggtttttgtggtagtttattttagaagtattatattttgttttgttgtttgttttgagatggaaaagtgttttttttgtttttttttaatagatttttagcgttagttgttttttggtatttaataaatatttattggtttttattttgtggtaatttgtgggttatatgttggggttaaggtagtagaattttaggttttttttttttatttttgatgtaagtgtaatttcgttgagggtagattggggtattttgtgttattaaattatattgtttttattttggtattttagatttttatattcgtgagaaattttggagagggtatttttgtagagtgtagattgtggttagtgataaataaattaggattaagaaagtttattgtagtttttaggaataatttttatacgattatttgatagggaattggggaatggggtatggaagtttttttatatttgagagaaaaaataggataataaaaattaaaagtttttttttttttggtttattgtgttaaggttatttttaattagtttgttttttatattaagagtttatgtttgtttaatggttggaaagagaattttgagattaaaaaattaataaagatgtatttttataacggttggtggagtggtagagtggaaagagtattgttttggaagttggatattttagtttgagatttagaacgttataaaggtgatatgtggatttcgttgatttgggttttagtttttttatttgtatacgatggggttggatttgattgttttgttgatgatatttttttgtttggatagagtaagatattattttttgaaagggagaatggtgttttaaattattttttttttagatagaatttttttgagttacgaggtttaatattgaaaattaaaggtttgggatgtagggaagtttgttgaattattttttaatttattttttaatttgaatttgtttgtgagtttttagtttatttataggttatatggtttggaataaaatgtaatagattgtaaataatgaggcggggggtggggaaagtgattggtagtagagtttatttaataggggttaggggttgggtaagatagaagtttaaatatagcgtaattagttaattatgggttttggggttaggagggttgaatggttaggtttattaatggagaaataatgcgattgtttatataatggaagtttttttgataaa

SEQ ID NO: 100 - DNA, 4501 bp, Artificial Sequence
  Chemically treated genomic DNA (Homo sapiens)
tttgttaggaaggtttttattgtgtggataatcgtattatttttttattaataaatttgattatttagtttttttggttttaaagtttatgattggttgattacgttgtgtttggatttttgttttatttagtttttagtttttattgggtgagttttgttgttaattattttttttatttttcgttttattgtttgtaatttgttgtattttgttttaggttatgtggtttgtgagtgaattagaagtttataaataggtttaggttaaagggtaggttagaaaatgatttagtaggtttttttatattttaaatttttaatttttagtgttaagtttcgtggtttaggaagattttatttaagaaagaaataatttaagatattatttttttttttagagagtagtgttttattttatttagataaggaaatgttattagtaggataattaagtttaattttatcgtgtgtaaatggggaaattgaggtttagattagcgaagtttatatattatttttgtaacgttttggattttaaattaaaatgtttaatttttaaagtaatgttttttttattttattattttattagtcgttgtagagatatatttttattggttttttgattttaagattttttttttagttattaaataaatataaatttttggtgtagaaagtaagttggttaaaaatgattttaatatagtggattaggaaaaaaaagatttttaatttttgttattttatttttttttttaagtgtaggaaaatttttatattttattttttagttttttattaaatggtcgtgtaaaagttatttttaaaagttatagtgagtttttttggttttaatttatttgttattagttatagtttatattttataaaaatattttttttaggattttttacgggtgtggaggtttaagatgttagaataagaataatgtagtttagtggtataggatgttttagtttgtttttagcgaggttgtatttgtattaaggatgggagaggagggtttggagttttattgttttgattttagtatgtagtttatagattgttataaagtaggggttagtgaatatttgttgaatgttagggagtagttgacgttggagatttattgagggggagtaagaaggatatttttttattttaggataaatagtaaggtaaggtgtagtgtttttaagataagttattataaagattttaaatattaaggaagaggtgtttggttgggatggagtattggggaagaggggttggttagatggtagaaagttggagttgatttgtagtgattgtttatttttaagttttagtttttttatttgttaatggggagtgtttatttttttttttttgttttagggatgtacgagtggtaagtggtggtggggaggtacgagaagagggtatttattattggtattttaaagtaaagttaattggagatttaggtttttaaaaggacgaaggttttggttttgtataaaaggttttcggttttttttttttttaggggagtgtgagttttttagggaaagaggtagtagtaaaaaaattttaggtttggagtgttttttaaggtattttttttaattttttatagtttaattttagtattgttttttttaagcgttaatttttattttaaattttttgttttttggggttttaataattattaaagggaggttggtttttacgttatttttttaaattgtttattaatatatttacgtgttagatagatacggttggggattatacgggtagttttagttaaagagaggcggagatggtttaagagtttgagaagagttaatgtttgattttaggtaggggtagagttttggttatttatggggtggtttttttttggatggttcggggaggtttttattcgagtcgtttgggttttcggattcggagtaggtttgggttttgggttcgtttagcggatagggggcggcgggcgtcgggttgtcggtttcgaggttgggagtgtagttcggggcggcggacgttttgggcgggttttttcggggcgcgttaggagcgagtcggtcgtttatagttttttttagtcgttttcgggtcgagaagtcgttttatatgtagttacggcgtatgatggaggcgtagtttttgttttagtttttcgagtggtttcgggatttcgtttcgttttcggtgtatttttcgggttacggtttcgggggattaatttcgggggtcgggttttttgcgtcgggatttaagttttagggcggcgacgtggggggcgatggtattagttcgaattttttttagatgttttcgttgggcgtcgtggagcggtagaaatttttttcgtagttatagtcgtagaaatagtgttggtacgagtcgtagtttatgttcgttttttgcgggagggaaggggggacgtgttgatcgggtgtcggtcgggcgaaggaggtgttttcgggtttttcggtatagtcggttgtcgggttttcgtttttttttaattttattagtttgtagtttgcgtttagttttcgcgtttcgggaagtcgggtttcgggttagagtggtaggggaagttaatcgtagcgcgcggattcgattgtgggtagcgagtttaaagtaaattttgttagcgtcgttcggagcgtagtttttagggttcggcggggtcgggcgggggcgcgtcgtgtttagaaggtagtttgtagttagttcgtatcgcgggattcgcgttcgtgttttggttattcgtagttttatttcgttttagtcgttcgttatttggagcggatcggtttttcgtcggttcggggtagttcggtagttagtatatacgtatatgcgcgtcgtcgagagcgcggttcgtatttataagcgcgtttttttcgcgcgcgcgttttttttcgttcgcgtacggcggttcggacgttttcgggatcggcgcgggagcgcgagttgtaggcgtattgttttttgattgttttatatttcgtcgcgcgttcgggatttagggattggggggcgggttttatgggataaatttcgttttttttttgtttattacgggtagtcgataggtggggtcggttttattttttggtagcgttcgttcgtttcgtttaattttcggtagttttttaaataaattgtacgttggggagcgtaaataggaggagggttgatgcggttcggcggtcgtttggcggtgttagtcggttgagttaaatcgtgttttttgtttatttcgagttggggaattagggttatttttcgttttattttgcgcgtttatttttttcggcgtatttcgttgggtttaggtgcgttcgagtcgtcgcgaggggtagggggagggaaacgcgttatttggcggtttttagttttgaatttgggttggtttcggcgttcgtttggttattcgtcggttcgttttttgagtttagtggtttaagtttggatggtatcgaagcgaagatttcgggatttagagttcgaaacgtaatttttttgagttttagttttatttgtaaaatgaagggatggtaatgtttattttatagggttgttgtgaggttttagggaaataagagtatttagggaaggggtttggtttaggtggagaggtagacggcgttggtttagttttcgttttggggaggcggtgtagaaatgaggaattttttttagggtaaagttagttgagattcgttatgtttttttttattttatataaaatattgtaggagttgtatagtagagaatgaggatttggtatttggaaaatattgtaggattaagttgttttaagttttgttttgtattgttggttaagatgatagataatttttttgtataattttttttttaaattttaaatatattttgttaagagatagggttttatttagcgttaaggttggagtgtagtggttcgattatgattcgttgtagtttcgaatttttgggtttaaatgattttttttttttagttttcgaaagtgtagggattataggtacgggttatcgtgttgggtttttttttgtgttattttttatatagatgatttttggtggaagagaaaaaattaaattatacggttagtttgagatttaggttagaggagagtaatttgggatagtagttaatatatttagatttttttatttggtattaaggtttggtgtttgtttattttagtttgattgtttgttgttttttttttttttttttatttttgtggtttaagaatattaaattatttattgttggtagacggaagtgagaagggtaagtaatttagtgtggttggagtatgggatacggatgtgtgttgttatatgggttgggaaggtagggaaaatgatagtttttcgttttagatacgttgggtttgtgttgtatgtgggatattttgaaggtagaaatttgtttttatttgttttgtgatttttgtatttagaatagttt

SEQ ID NO: 101 - DNA, 4501 bp, Artificial Sequence
  Chemically treated genomic DNA (Homo sapiens)
atatatttgtaagaaaagttagattagagtgaagtaaagttaggatttgatggtggcgggaagggaaggggttaatgttgttgttggatagaggggtgttattttttttagaagaatagtatgtcgtggttattattataataatagttgatataattattatgggttggggatttataagagtttttataatttttaggtaggaggtattacgaattttattttataattgaggaaattgaggtataaagaaacgaagtagtgatagtagtttttttttttttttttaatagtttggaattaagttgtttgagtcgaggttgggttttaggaggtgtggatagtatttttatttcggtaaattagattcgtttgtttataattggggagaatggtggttttgaaaaggttaatttgggagttttggggacggttgtagggaacgtacgtttattttttttaggaagtagagttaggtcgttttttttttcgtagtggtgaggacgcgtggatagtttcgcgggggcggcgggagatttgcggagtggtcgtattttaggttcgcgttaaggtcgggtagtttcgttttttgtttagttttcgcgaggtgtcgttttcggtcgaagaaattatcgcggcgttattttcgtagttcgtatttatttatttatttatttttaaataaggggggcgtttttttttttttaatttgaaattggaaatatttagaggttttgtttttaagggggcgcgttttttttttgttattttgtattttcggattagttttttttcgtaattatataggagtaatttttttgtaaggttttgtttaacgttggtttcgcgtttagttgtataatacgtagttaaagcgggggttgggttagaagtatcggttttttttttttaatatatattttcggagtttttcgtaattttttttttttttaatgataagtaattgttaggttcgtagggtgggtgttgtattgtatcgtttcgcgcgtagttggtttttagagtgtagtcggtgtaagttcgggggtttaaaagggcgggaggagtatattttgggttttttagttttgtagttttttttttgtaaagaaaagtaagtggtttttggcgcgaaagttttggcgttttttttgatttttatggaaattaggagggcggggtaaagtcgtttttttttttttttttttttttttttgtttgcgttatagttttttttttttttcgtttttcgggtgtgttagattttttagttaataatatttttcgagttttaaagcgtaggttgtgatagttatttgtttggacgcgttgggtggatgcggggggtttttgggaattgtgttggagtcgagtaagcgttagttaggcgtaagcgcgtatagattgtagttattcgaggatattttcgttttttcggtttattcggagatattcgcgtagaatcgttttcggattttttgtagtcggcgggaggtaaggagtagggtttgtaaatcgttcggcgtttagggaagcgacgagcgtcggggtaaggtaagttttggacgggattgcgacgtgcgtatcgggcgttttaatatgttcgggggattgtttttgttttcgaaataaaattatttttgggtttttttagaaaagttagttttagtttcgaaggtattttggttagaggagattcgttttaatttttttgtagtttttatcggggggagtaatggtttttgcgaaaagaaattttttcggttttagaagatttgtttgtgtttgagttgtcggagagtcggtgcgtttttattttaggttggggtttttttttaaagggtgtttttggaggaagaagagggggggattaggtagggcgaggtcgtcgcggtcgtaatttgggttacggttgttttagtttggaggagaggcggttttttcggcgatttttttcgcgcgggcgtttttgttattttcgggaataggggtttagtttttttttttttggaagaggacgttgtcgtgggtttggaagagtaggggtgggtttagagagtttttaattaagttattggtaggagtatttttgtagcgggtgaatgtcgaggggcgtttgtttaaatttggggaggggaaggatttgtggatatgggtgtttgttgttggtttttgtttagagaaaggtttttttttatttgtaaagttttttaaattttttgttattatttgtatttttgaggttgtatttttataaagggggtagaaggtattttaaatattattttcggtagttgggtcggagagtttggggttttttttgagtagtcggttttatatcgttgcgagtgcggttgtttgcgtgttcgtgagagttagaattttgtagttaggaatagtttttttttttaggtagtgttttgtgtgaatgaaatggtagtttttaaagttgcggagtttcgttattattttttgtatttgtatgtttttttttattttttgtcgtagatagtttgtatataaaaggagggcgggagggagggagcgagaggtataattttttttattttcgggagtagtgggtagagtggggggtttggagggaagattggggaatttggttagagggggcgtttattgtttattttttcggtttgtttcgtttgtttatttttttcggtgtgtttgtcggttgtagtgttggaggtcggcgtcggttttcgtttttcgcgttttttacgggaaggaagtattttcggtattaaaacgaacggggcggaaagaagtttttagtcgtcggtcgggaggcgagtcgatgtcgagttgttttacgtttattatgtcgggtatgatttgtaagaatttagatttcgagtttgattcgttatagttttgtttttattcggacgaagatgatttttatttcggcggtttcgattcgattttttcgggggaggatatttggaagaagtttgagttgttgtttacgttttcgttgtcgtttagtcgtggtttcgcggagtatagtttcgagttttcgagttgggttacggagatgttgtttgagaacgagttgtggggtagttcggtcgaggaggacgcgttcggtttggggggattgggtggttttatttttaattcggttattttttaggattgtatgtggagcggttttttcgttcgcgagaagttggagcgcgtcgtgagcgagaagttgtagtacggtcgcgggtcgttaatcgtcggttttatcgtttagttttcgggagtcggcgtcgttagttttgcgggtcgcgggtacggcggggttgcgggagtcggtcgcgtcggggtcgttttgttcgtcgagttcgtttattcggtcgtcgagtgcgtggatttcgtcgtggtttttttttttttcgtgaataagcgcgagttagcgttcgtgttcgtagtttcggttagtgtttcggcggcgggttttgcggtcgtttcgggggcgggtattgtcgttttagtcggggtttcgggggtcgttttttcgcgtttaggcggtcgttagattagcggcggcgattataaggtttttagtattttcggagaggatattttgagcgatttaggtaaagatcgaattcgggttcggttgtttttttggggtattggatttcgggtcgcgttttttttgttagtgttcgtatgttttggtttggggagtattttggaggtagtgttaggggtagagaggttttgttttttttaagttttttttcggggtaaagagaaggggttgagagaatgtcgttgtaaaaggggtgttttttaattttcgtttttattaaagttttttttatttttttttggggagtttttttttaggttattacgggtttttattcggttttttattttttttttgtagcgtagtttgaggaataaaattggagaaagttggtggttaaatcgggtgggggtttagggggttgttgggtgtattgtttggatagaaatttgttagcgtaggggtgaaagggattttttggtttaggttaggggagggaaagatattttcgagaagatttaagggttgtgtaaagttttgtttaaggcgtaggaatttataggagggttgtaatagatggttagagtcgattttttattttttttttttttttttttttttttttaaatgtcggtatttttttttttttttattttcggtgggtggtgggttatttgtttttggtgcgtggttagtaggcggcgatatgcgaggttagtaggcgggttcgggatttgaaaggttgggggtggtgggggtattttttttttttttatttagtagttggttgtaagtgtaatagtagttgtgtatatttttagggggttttttttttttagtgtgtagtggaaagtggttgtagttttgttttttagtttgaattttaggtttaatttgagatgtgagttgtatttgtaatttagtgtttttgaaggtgagggtaggtatttagtagtt

SEQ ID NO: 102 - DNA, 4501 bp, Artificial Sequence
  Chemically treated genomic DNA (Homo sapiens)
ggttgttgagtgtttgtttttatttttaagggtattgggttatagatataatttatattttaaattaggtttggaatttaggttggaagataaaattatagttattttttattgtatattggaaagaggaggttttttgagaatgtatataattgttgttgtatttgtagttagttgttgaatggagggagggagggtgtttttattatttttagttttttagatttcgggttcgtttgttggtttcgtatatcgtcgtttgttggttacgtattaggagtaaatagtttattatttatcgaggatgggggaagggaaaggtatcgatatttgaaaaaaaaaaaaaaaaaagaaaaagaatagaaaatcggttttagttatttgttgtaatttttttataagtttttgcgttttaaatagggttttgtatagtttttgaattttttcggggatgttttttttttttttgatttgggttagagagttttttttatttttgcgttaataggtttttgtttaggtagtgtatttagtaattttttaaatttttattcggtttagttattaattttttttaattttattttttagattgcgttgtaaaagagaggtgggggatcgggtgagggttcgtgatggtttagaggagggttttttaggagagggtggaaggaattttagtgaaggcgagaattggagagtattttttttgtaacggtatttttttagttttttttttttatttcgaggagagatttgggggaaataggatttttttgtttttagtattgtttttaaaatgttttttaggttaagatatacgagtattaataaaggggacgcgattcggggtttagtgttttagggaggtagtcggattcgagttcggtttttatttgaatcgtttagggtgtttttttcggaggtattgagggttttgtggtcgtcgtcgttggtttggcggtcgtttgggcgcggaggggcgattttcggggtttcggttggggcggtaatattcgttttcgaggcgatcgtagggttcgtcgtcggggtattggtcggggttgcgggtacgggcgttggttcgcgtttgtttacgggaaaggggaagattacggcgggatttacgtattcggcggtcgggtgggcgagttcggcgggtagggcggtttcggcgcggtcggttttcgtagtttcgtcgtgttcgcgattcgtagggttggcggcgtcggttttcggggattgggcggtggaatcggcggttggcggttcgcggtcgtgttgtagtttttcgtttacggcgcgttttagtttttcgcgggcggagaagtcgttttatatgtagttttggaggatgatcgggttgggggtgaggttatttagtttttttaggtcgaacgcgtttttttcggtcgggttgttttatagttcgtttttaagtagtattttcgtgatttagttcgggggttcggagttgtgtttcgcgaagttacggttgggcgatagcgggggcgtgggtagtagtttaaattttttttagatgttttttttcgggggggtcgagtcggggtcgtcgaagtagaagttattttcgttcgggtagaagtagggttgtagcgagttaaattcgaggtttgggtttttgtagattatgttcggtatggtggacgtggagtagttcggtatcggttcgtttttcggtcggcgattgagggttttttttcgtttcgttcgttttaatatcgggggtgtttttttttcgtggggggcgcggaaggcgggggtcggcgtcgatttttaatattgtaatcgatagatatatcggagagggtgggtaaacggggtagatcgaggggataggtaatgggcgttttttttaattaggttttttaattttttttttaagttttttattttgtttattgttttcgaaggtggaggaagttgtgtttttcgttttttttttttcgttttttttttgtgtataagttgtttacgatagggggtgggagggggtatgtagatgtagggggtggtggcgaggtttcgtaattttggaaattgttattttatttatataaggtattgtttgggggagggggttgtttttggttgtagaattttagtttttacgagtacgtagataatcgtattcgtagcggtgtggggtcggttgtttaggggaagttttaggtttttcgatttagttatcgggaatggtatttggagtattttttattttttttgtaaaaatgtaattttaggagtgtaaatgatagtaggggatttagaaaattttgtaaataaaaaaaagtttttttttagatagagattaataatagatatttatatttataaattttttttttttttaaatttgagtaaacgtttttcggtatttattcgttgtagggatatttttgttaatagtttaattggaagttttttaagtttatttttgtttttttaaatttacgataacgtttttttttagggagggagaggttgagtttttgttttcgggaatggtaggggcgttcgcgcgaggagggtcgtcgggagagtcgttttttttttaagttggagtagtcgtgatttagattgcgatcgcggcggtttcgttttgtttaattttttttttttttttttttaggggtattttttggagaagaattttagtttggggtggggacgtatcggtttttcgatagtttaaatatagatagattttttagagtcgagggaattttttttcgtagaagttattatttttttcggtaagggttgtaaaaggattagggcgggttttttttagttaggatgttttcggggttggaattggtttttttgggaaaatttagagatggttttgtttcggaagtagaaatagtttttcgggtatattagggcgttcggtgcgtacgtcgtaatttcgtttagggtttgttttgtttcggcgttcgtcgtttttttgggcgtcgggcggtttgtaagttttgttttttatttttcgtcgattgtaggggattcggaggcgattttgcgcgggtgttttcgggtgggtcgggggggcgggggtgttttcggatggttatagtttgtgcgcgtttgcgtttggttagcgtttgttcggttttaatatagtttttaggagtttttcgtatttatttagcgcgtttagatagatgattgttatagtttgcgttttgaagttcgggggatattattaattgaaaaatttgatatattcggggggcggggagagaagggggttgtggcgtagataagggggagggagaaaggagaggaaagcggttttatttcgtttttttgatttttataaaaattaggggaggcgttaaggttttcgcgttaaaagttatttgtttttttttgtagagagaaggttgtaaagttgggaagtttagggtgtgtttttttcgtttttttggattttcgggtttgtatcggttgtattttgagaattagttgcgcgcggagcggtgtaatgtagtatttattttgcgagtttggtaattgtttgttattaaaagaaaaaaaaattacggagggtttcgggggtgtgtgttggggaggggagatcgatgtttttaatttagttttcgttttgattgcgtgttgtgtagttgagcgcgaggttaacgttgagtaaggttttgtagggaggttgtttttgtgtaattacgaaagaaggttagttcgaaggtgtaaaatagtagggagaggacgcgtttttttaggaataagatttttggatgtttttagttttaaattgaaagaagaggggcgttttttttgtttgaaaataaataaataaataagtgcgagttacgagggtggcgtcgcggtggttttttcggtcgaaggcgatatttcgcggagattgagtagaaagcggagttgttcggttttggcgcggatttggagtgcggttatttcgtaggtttttcgtcgttttcgcgggattgtttacgcgtttttattattgcggaggaggaggcggtttggttttgttttttagggggaatgggcgtacgttttttgtagtcgtttttagggtttttaagttaatttttttaaagttattattttttttagttatgggtaggcgaatttgatttatcgagatggaagtgttgtttatattttttgagatttagtttcggtttaaatagtttgattttaaattgttgaagggaaaaaggaaagttgttgttattatttcgtttttttgtgttttagtttttttaattgtgaaatggagttcgtagtgttttttatttgagagttatgaaagtttttataagtttttagtttataatagttgtgttagttattattatgatgatgattacgatatgttatttttttggggaaaataatatttttttgtttagtagtagtattggtttttttttttttcgttattattaaattttggttttattttattttggtttagttttttttataggtgtat

SEQ ID NO: 103 - DNA, 1446 bp, Artificial Sequence
  Chemically treated genomic DNA (Homo sapiens)
ggagtcgttgggtttaggatggataatggttttcgttggtgtatgagatttaggttatttttttattttttgtggtttatttgtttatattgattgattgattggttgattaagatggttttgttttgttgtttaggttggagtgtagtggtgtagttataggttattgtagttttaattttttgggtttaagtgatttttttattttagtttttggagtagttgggaatataggtgtgttattatattagattaatttttatttttttttgtggagacggggttttattgtgtcgtttaggttggtttggaatttttgggattaagtaatttttttgtttcggtttgttaaagtgttgggattataggtatgaattacgggtttttattattacgttttaggaaatgtttatattggagtgtgttttttgtttttagttgggttttcgattggttattgtggtttaatggagtgtggtgtcggtagttgttagcgtttgttttttgagaggggtggcgaggggtatataggattagattgtttttattgttggatgattgggtaagtcgttttttttttttgggtttttgttttttaatatttaatattttgttgtgggttaagtgaagtttaagtttttttcgattttaatatgaggttgtttcggaatatttattttgtgttttgaatttaataatcggttgtggagggtattataggtaaatttgtattgtgagtgggttgttgttatttaattatttgatagtagttgcgaataggtgggtagtgtgttttttataggtagcgacgatttttggaggtggatttagaggtataattaagtcgcgcggcgtattagggtttaagggtatggggttttcgtagttgtggttggggtagagttggggttgtttttttttttaggagtataggcggcggtttagttttacgtttttcgtttttagttatattcggttcgcgtagtggggggtttaatagatttttttttttcgggttttagttttttcgttagtaagggcggataaggatttttttcgtttcgttagaggaggcgatcgaggggtttgagtttaggtataggtcggcgggtttaggaggcgcgaggcggatcgaattcgcgggaggagtaaagatttttgatgcgcggtcggagggcggggcggaggacgggatttacgcgattggtattttgtttttcgttttagttaatgagcggcgagggtgttttgggggcggggtagaattagtttttaagttgtagtgacgtttcggcgttattgttgcgttttatagacgtcgcgtgtattcggttgtttttaggcgttgttaggtatcgtttgggcgtcgttgttttggggttttggttcgggtttggtcggggttttttgatagcggcgggggaggcgggcgggcgtagggtgtcg

SEQ ID NO: 104 - DNA, 1446 bp, Artificial Sequence
  Chemically treated genomic DNA (Homo sapiens)
cggtattttgcgttcgttcgtttttttcgtcgttgttagggaatttcggttaggttcgaattagagttttaggatagcggcgtttagacggtatttgatagcgtttgaggataatcgggtatacgcggcgtttatgaagcgtaatagtgacgtcggagcgttattgtaatttaaaggttgattttgtttcgtttttaagatattttcgtcgtttattggttggggcggagggtaggatattaatcgcgtgggtttcgtttttcgtttcgtttttcggtcgcgtattaaggatttttgtttttttcgcggattcgattcgtttcgcgttttttgagttcgtcggtttgtatttgagtttaggtttttcggtcgttttttttggcgggacgagaagagtttttgttcgtttttgttgacgagaagattgaggttcgaaaaggaaaagtttgttgggttttttattgcgcgggtcgggtgtggttggaggcgagagacgtgaggttggatcgtcgtttgtgtttttggagggagggatagttttagttttgttttagttatagttgcgggagttttatgtttttgaattttgatgcgtcgcgcggtttagttgtgtttttgagtttatttttaaaagtcgtcgttgtttatggaaaatatattgtttatttgttcgtagttgttgttagataattgagtggtagtaatttatttatagtatagatttgtttgtggtgttttttatagtcggttattaaatttagaatataaaatagatatttcgggataattttatgttagaatcggaagggatttggattttatttagtttataataagatgttaaatattggaaaatagagatttagagaaggaaagcgatttatttagttatttaatagtaggggtagtttggttttgtgtgtttttcgttattttttttagagggtaggcgttggtagttgtcggtattatattttattagattataatgattagtcgggggtttagttggaaatagagggtatattttaatgtgaatattttttaaaacgtggtggtgggggttcgtggtttatgtttgtaattttagtattttggtagatcgaggtaggaggattgtttgattttaggagttttagattagtttgggcgatatagtgagatttcgtttttataaaaaaaaataaaaattaatttggtgtggtggtatatttatgtttttagttattttaaaggttgaggtgggaggattatttgagtttaggaggttgaggttgtagtgatttatgattgtattattgtattttagtttgggtaataaagtaagattattttaattaattaattaattaattaatgtaggtaagtaaattataagggatggagaaataatttgggttttatgtattagcgagggttattatttattttaggtttaacggtttt

SEQ ID NO: 105 - DNA, 2501 bp, Artificial Sequence
  Chemically treated genomic DNA (Homo sapiens)
ttagttttttttttttcgatttcggaataattcgacgttttagtagggagtagagtttttttttgatttttgtattttttttaatgtataacgagttttttgtttcgtttttttttagatggcggatttcgtatttgtttagattttttttttaggttttcgtttttttttcgcgtgttttagggatagtttgttatagttttttttttttttcggtgttttattttgtagattttagtttttcgggttaagtaggttgtcggtgaagaaacgcgtcgggttagtaatttcgttgagtagtattagtttcgttattttttttttttattttttaattaggagacggtttttaaggttcgtttttttttattattaattaattagttgatttttttaaaaaagggggcgtttcggaagttttatcgattagtaagagatttgggtgttgagtacgtgaattaatagatgcggatgattgtgtaggcgggtttaatgggagtatagtagtaggaagtaatttttagatagtgttatatcgttaagcgtatgcgttaaataggttttagtgataaagcgtttgggagatgtagtatttagtattaaggtttattattttttttagttattattaagtttagtttagatagtttttatgtgttttcggagatagataagttttttaaaaggggcgtattgtgattattgttattttttttaggaagttaaaagttgagaatgggatatgggttgaaattttttttttggttttttatttttaaattttatagtatagattataatttataagtttttgttttttttaaggtttaatttttaattagttaaatattttgcgtagattttgagttagttttgtattttggttttttttttgaatgattattttttttagttttttttgggttgttcggtttttgggatttatcgttagtatttttttgaggttagtagttgttttttttaggtttttaagggtagtttgggtaattttttttcggtataaggtttttaaatggttaggttttcgttttaatattcggttatagttttgggttgttaattgaggttgttttagtaataattgataggtagttagattggtatgaaggatagttcgttttggagggttaggtgggggtaaagttaggagtagtcgaagagttcgtttatagtatcgggtagtttttttagggtttttagttcgaaatagttttgtgttttttgtacgtttttttttggttagggtttttttttcgttagtttttagtttttaggagtttcggttttgagtgaaggatgttagtgtgagtttgataggaggtttagagtgtttaggtagttgaagttttgtttttttattttgatatatggattttaagtatttttttatgagttttttttaagttttttttttttatggttttacgtttatagttagttttgtttagttttttggcggttttgattcgaaaggaaattttaaagttagtattcggtagtaggagtttagtttgggtttgtttaagttatggttacggattacgatttttttgataaagtttttatcggggtagtattagagattagaagtttgaagggtttttggtatttgattggttgatttatgagatttatgagagttttttttaagtttagtaattagttttttagttttttgagtatgttttagaatttggttggttggatttgggtttatttttagtttaagcgtttcggtaggagggtttcggggttgttgtttaatttgaataattgaattaaggttttttcgaaggttttttttttatttttgttgcggttgagaggtgtttttttttttaattgtattgattggtggcgtttttatatggatgtttagttttttttacggtgagtgaatagttttggttagaaagggatgaattaggtttaggttagtatttgaaaagaaaattaaataatgttaatagtagggtttttatttagatttttttttcgtttttttttatttttttgagatttaggtttttagttttgaaagtttttagttttgtttttttttaaaaatttgttttagttttttcgttttatttatatataatttagaattataaattttataattttttgcggttaaggtagtcgcgttaattacggatattcggtcgggttaataagtatttgcgcggttaaagtgtttggtatggtgataggaggagtcgggttattcgaattatttttttttttaaagttaaatggttattgaatgttgttttcggagttttgttttacgcggagagggtagtcggagaggggcgcggtgcgggaggcgggggtagggggcggaataattgggaaagatattgataattaattttggagttcgcgagatttcgaatttagttaaatttttggtagttaatcgggagaagggaggaatttggttagttcgtttattgaacgtgatattatttttttcg

SEQ ID NO: 106 - DNA, 2501 bp, Artificial Sequence
  Chemically treated genomic DNA (Homo sapiens)
cggaggaaatgatgttacgtttaataggcgggttaattagattttttttttttttcgattggttgttaggaatttgattagattcggagtttcgcgggttttagggttagttgttagtattttttttagttgtttcgttttttattttcgtttttcgtatcgcgttttttttcggttgtttttttcgcgtggggtaaggtttcgagggtagtatttagtagttatttagttttggaaggagaggtgattcgaatggttcggttttttttgttattatgttaggtattttggtcgcgtaggtatttattgattcgatcgggtgttcgtagttggcgcggttattttaatcgtagggaattgtggaatttatagttttaaattatatgtgggtggaacggggaagttggagtagatttttggaggaaagtaaaattggggatttttaggattaggggtttgggttttagaagaatgggaaaggacgagaaaggagtttaaataagaattttgttattagtattgtttggttttttttttaggtgttgatttgaatttggtttatttttttttgattaaaattgtttatttatcgtggaagggattaagtatttatatggagacgttattagttaatataattggagaaaaggatattttttagtcgtaataagagtgggaaaagaattttcgggagaattttgatttagttatttagattaggtagtagtttcgagatttttttatcgaaacgtttgagttggaagtaagtttagatttagttagttaaattttagagtatatttaaggagttgaaaaattggttgttgaatttgaaggagatttttataagttttatggattaattagttagatgttagaggttttttaagtttttgatttttggtattgtttcgatgggagttttgttaagaagatcgtaattcgtggttatggtttggataaatttaaattaggtttttgttgtcgggtattggttttggggttttttttcggattagggtcgttagagggttggatagagttaattatgggcgtagggttatggagggaggaaatttggggggagtttatagagaaatgtttggagtttatgtgttaaggtgaggaagtagagttttagttgtttgggtattttggattttttgttaggtttatattggtattttttatttaaggtcgagatttttgggagttggagattagcgagaaggaagttttggttagggaagaacgtgtaaggggtatagaattatttcgagttgggaattttgaaggagttgttcgatgttatggacgggtttttcggttgtttttgattttatttttatttggttttttagaacgaattgttttttatgttaatttggttgtttgttagttgttgttagggtagttttagttggtagtttagagttgtgatcgggtgttggagcgggagtttggttatttaaaggttttatatcgaaggggggttgtttaggttgtttttgggaatttggaaaaagtaattgttgattttaagaaggtgttggcgatagattttaaaaatcgggtagtttaggaggaattggggaaggtggttatttaggggaagaattaggatgtagggttggtttagggtttgcgtaagatgtttggttgattaaaagttaaattttaaaagagataggaatttgtgaattgtggtttgtgttgtgagatttgggggtggggggttagagggaaggttttagtttatattttatttttagtttttggttttttaggggaggtagtagtggttatagtgcgttttttttgaggggtttatttattttcgaggatatatagaagttgtttaaattaaatttagtagtggttgggggagatggtggattttaatattgggtattatattttttaggcgttttattattggagtttgtttggcgtatgcgtttggcggtatggtattgtttggaagttattttttgttgttgtgtttttattgggttcgtttatatagttattcgtatttgttgatttacgtgtttagtatttaggttttttattggtcggtagagttttcgggacgtttttttttttgaaagagttaattgattagttggtgatggggagaggcgggttttgggaatcgttttttggttggggggtgggggggaaagatggcggagttgatgttgtttagcgagattgttgattcgacgcgtttttttatcgataatttgtttagttcggaggattggggtttgtagagtgaggtatcggggaggggagagggttgtggtaaattgtttttgaggtacgcgggaaagaagcgggggtttaaagaggaagtttgggtaaatacggaattcgttatttgaaggagagcggagtagggggttcgttgtgtattaagggggatataaaagttagggaagaattttgttttttgttggaacgtcgagttgtttcggggtcggggaaggaggggttga

SEQ ID NO: 107 - DNA, 3001 bp, Artificial Sequence
  Chemically treated genomic DNA (Homo sapiens)
ttgttataattgggtcggtaggggaagaagggaagggggatttggatgggttttcgtaaaataggtgaaaataaggggtgaagagtaggggattgaggaatagtaaaggaaaataaagatattatttttaatagaagagttggaggggggaaaaaaaaagtaagatttaattacgattttttttttatttttagtttttattttttttaaattaggaaatttttatttggaaagaaaaatagatataaaatataaaaacgaaaagtaaatataatagaatagaaaaagtagtattagggaaagtggttaggatagaggtttttaataagattagtaattatagtagcggaaattagaaaagttggaaggggaagattaatttataaatttttgatttgaaagtaatagtgaggaaatagaatagataataaaaggtaaaatatgattaataatttagtaaagtggaaaatggagatgataagtagagttttgaaaagtttttaaaggaagatttcgttttttttattataattttatcgttatggatgtttaatttagtagttattagttaagggtgatagatgagggttattattgcgtaaagcgtttatttttcgaaaagaaaatattatatggtcgtcgtttattttttatagtttttagttttttattttttagtattttttttttcgttgtttaagtaagttttgtgtaattagtatgggggggaggggcggtgtaagataaatggttcggttataaaaaaataaaatttatgtttttattttataataagaaagttaataggtgatagagaaaggtaattttcgtttaggttttaataggatttttattaagtggttttatattattgttacgttacgaaggtgagattttttttggagaaatatataatgatattaatcgtatcgtaaatatttggaaggtattttaaattaagttgggtaagttaaggtgagaaaaatttaattgggtttagaaattagtttttttttttagttttatcgagggtcgaaaaagagtttaagaaagaataaggaaggtgagaagagtttcgtttttcgtaaatattaagattaagggacgtcgagtatcgttttttattgatgttgaggtttttaatatgagaagaatttattggaagaagggagtaaaacgaatataatggcgtcgaggatattattttggattgggtttttttttagtttttttttttttttttaggagttttttgttttcgaaagggatgtaagttaaggaaatagcgaattaattaggttttagcgattagattatcgtttgtgaaaagggtattaggaatttatgtgacgggatgggtgcggagaagcgtagatggaaacggattgtagcgaaggttaaagtttatttaaatagggagagcgcgtatggcggtagtaatagcgacgaaggagggaaatttgtttttattttcggttgtaggtttttttttattttagtttttcgtttttttggttgtaagagcgtaggcgtaagggatcggaaatagggtttttcgcggttatatagattcgtgcgttttaggtttgtttttggaaaatgtttgtttgaaatttgttttaaaatcgtttttaattttattgttatcgttagtaataaaagatataaaggaaattaacgtttgttttttattgttatttttatttttttattttatttttttttatgttttttattttttcgtttaggtttttgttacgtaggttttttttgtaggtattttttcgtggatgcgcgaggaacgagtgtggcgaaggttgcgagtttttacggggtttttggttcggtagtgaaggtgatttgaggattgttgggtacgtattaggaatcggtaggttttagttgaggggagggaggagggaagttttagggaattggattgttcgggggtgtttttcgatttttttttagtcgtggggttggtgggcggtatttttttaaaaggatgttgttcgaggtagttgatgttttagggttagtgagttaggaaggtgttttgaattcgagcgggaagacggggtttggattcggttttaagtgttaatagtagggtttgagggttatattatattttattaatattgtttttgtttttgttttgagatagagtttcgttttgtcgtttaggcgggagtgtaatgttttgatttcggtttattgtaatcgttgtttttcgggtttaagcgatttttttgttttagtttttcgagtagttaggattataggcgttcgttattacgtttagtaaatttttgtttttttagtagagacggggttttatttatgtatgattttaggtgatttatttatttcggttttttagagtgttgggattataggcgtgagttatcgcgttcggtttattaatattgttaattcgagtagaatgtttttggtttcgttttaatagttttattgtttaatttggattttttttttgaatgaaatatttgttattttcgtttttgagatggggagttataaaagtaagatttgatgttttgttgtgtaataaaataataaacgtttggttttttttttgttagtatatttaattatttaatattaaggagtaggtatcgttatttttattttattgatagaagcgaagtaaagtaatatattttaagtagtacggttggtgaggttatagttaggatgtaaatattttttattttttattgtattttgtttttttgtttaaagaatttggttagtaaatatattgtaggttattttattggtttaaatttttggtgaagtaagtttgtttttagtgataaatgaagtaattaatttaagaatggtgttatagaaggtatttttttaagtattatttaatttatttaaaagtatttattaattgttttttttgtgttatatgttgttttaggatttggggatataacggtgaatagttttgtttttatagtgtttatat

SEQ ID NO: 108 - DNA, 3001 bp, Artificial Sequence
  Chemically treated genomic DNA (Homo sapiens)
atgtaaatattgtgagaatagggttgtttatcgttgtgtttttagattttaggataatatgtggtataagggaggtagttgataaatatttttgaataaattaaatgatatttgggaaaatattttttatgatattatttttgaattagttattttatttgttattgaagataagtttattttattaagaatttgaattaataaggtaatttgtagtgtatttattaattagattttttgagtagggaggtagaatataatagagaatgagagatgtttgtattttggttgtaattttattagtcgtattgtttgagatatgttgttttgtttcgtttttgttaataagatgagaataacggtatttattttttagtattaaatgattaagtatgttaatagggagagggttaaacgtttgttgttttattatatagtaggatattaggttttatttttgtggttttttattttaaagacggggatagtaaatgttttatttaggaaaaaaatttaggttgaataatggggttgttggggcggggttaagaatattttgttcgaattaatagtattaatgggtcgggcgcggtggtttacgtttgtaattttagtattttgggaggtcgaagtgggtggattatttgaggttatatatgggtgaagtttcgtttttattaaaaaaataaaaatttgttgggcgtggtggcgggcgtttgtaattttagttattcgggaggttgaggtaggagaatcgtttgaattcgggaagtagcggttgtagtgagtcgagattaggatattgtattttcgtttgggcgatagggcgagattttgttttaaaataaaaataaaaatagtattaatggaatgtagtataatttttaagttttattattaatatttggggtcgaatttagatttcgttttttcgttcggatttagaatatttttttgatttattggttttagggtattagttatttcggatagtatttttttgggaaaatatcgtttattagttttacgattgggaaagagtcgggaaatattttcgagtaatttagttttttgagattttttttttttttttttttagttagggtttgtcggtttttagtgcgtgtttagtagtttttaggttatttttattatcgggttaaggatttcgtgggaattcgtagttttcgttatattcgtttttcgcgtatttacggaggggtgtttatagagaagatttgcgtggtaaaaatttaaacgaagagatgaggggtatggagaggagtaggataagagaataaagataatagtggggggtagacgttagttttttttatattttttgttattggcggtagtagtgaagttagaaacggttttaaaataaattttagataggtattttttaaaggtaagtttggagcgtacggatttgtataatcgcggaaggttttgttttcggttttttgcgtttgcgtttttgtagttaagaaggcgggaggttggagtagagggaagtttgtaatcggaagtgaaggtagatttttttttttcgtcgttgttgttgtcgttatacgcgttttttttgtttaggtaagttttggttttcgttataattcgtttttatttgcgttttttcgtatttatttcgttatatgggtttttgatattttttttataggcgatggtttggtcgttggggtttagttggttcgttatttttttagtttgtatttttttcgagagtaaagagtttttgggggaaggaagggaagttaaggggggatttaatttaagatggtgttttcggcgttattgtgttcgttttgttttttttttttaatgggttttttttatattggaggttttagtattaatgagaggcggtgttcggcgttttttggttttggtatttgcggagggcggggttttttttattttttttgtttttttttgagttttttttcggttttcggtgggattgggaggaggagttggtttttgggtttagttggattttttttattttgatttgtttaatttaatttggagtgttttttaagtgtttacgatacgattggtgttattgtatgtttttttaaaaggagttttattttcgtagcgtaatagtgatgtgagattatttggtaaagattttgttaaagtttgggcggggattgtttttttttgttatttattagtttttttattgtagggtggagatatgaattttgtttttttgtggtcgagttatttgttttgtatcgttttttttttttatgttaattatataaggtttgtttaaatagcggaagggaggatattgagaagtgggaggttgagagttatgggaggtggacggcggttatatgatgtttttttttcgaaaggtgagcgttttgcgtagtgatgatttttatttattatttttgattgatggttgttgagttaggtatttataacggtgggattataatagggaaagcggagtttttttttgaggattttttaggattttatttgttatttttattttttattttattaagttattagttatattttattttttattatttattttatttttttattgttatttttagattaagaatttataagttggttttttttttttaatttttttggttttcgttattgtgattgttaattttgttgggaatttttgttttaattattttttttggtattgttttttttgttttgttatatttgtttttcgtttttatgttttgtatttgtttttttttttaggtaaaagttttttggtttagggaaagtgggaattggggatggaaaagaggtcgtgattaagttttgtttttttttttttttttttagtttttttgttagaaatagtatttttgtttttttttgttgttttttaattttttattttttattttttgtttttatttattttgcgagaatttatttagatttttttttttttttttttttgtcggtttagttatggtag

SEQ ID NO: 109 - DNA, 5477 bp, Artificial Sequence
  Chemically treated genomic DNA (Homo sapiens)
tataaggattgtgggttttttaggggtttcgtgttaggagttagaaggggtatagattgtttttttttaatagttgtattatttgtttagagttagattgagtttggagggttttggaagttagaaggattgatatggggttggaggtagggaaaggttgttggaagagggagaaattgaggatttacggtttttaggtagtttgatttgttttaggtttggttggggtttgttttcgttataggtggttacggtttttttgtaagaattgttggggtttttattatagttgtagtatcgtattcggttttttggtaggagaaaagaggcgttggatttgggttttcggtggagtcggttggtagaaggtttgtgtgagaagttagttggtcgtttttttatttaaggtagtttttagtagggagttgagtaagattttaataaattggggttttatcgtagtttgttcgtgttaggatcgtttttattttttgtttatttttttttttagttcggttttgtttgttttatatttttcgtgttttgagttttatagggttataaaaaaggaagaaagagttttttttagtaggtattaagggttttagtggggatagggaggggttttatagtatgtttttagtattttttggagtttttaaatttttttatttttagtagtagtttgtggattaataagaatttttgaggatttttgatatttttttatagggtttttgagggttttttttttgtaattatttgtgtaaggttagattttttttatatattggattttaacgaaaataatatattttaatagattgaatgtagaagtagataggaaaatttaggtattttttacgaagtttgatattagatttataaaaatgtaaagtaatgtttagttttttattgtgttgtggagaaataatagttattttttataaaattgtattttgttagtatgtaatattttattatttttattgtttaaataaattaataaatatttattttaaattttttgttttaatttttaatgtagtaaatattgatataattttataaagaaaagttttttagagttttaagtaattttgaaaagtgtaaagaggttttgagattaatatttttgaaaagagttgtttttttgggtatttgtgttttttttatttttattttttgtttttagttttattttttttggtatatgttggttttgattttttagatgggttttttttttttttagtttttttaattttagttttttaggttgtattattatttttttattttaaattttatttatgtttttttttttagtgatttttttttagtgtaagtatattagtaggttttttagttttattcgtggttattttttttttttaaggtagtaaagttggtagggataattatagggtaggaatgttgaagtttggggggattaaagggatttgaagttgggtggggttcgtttttatatagttgggttttgtgtgtgtatgtgggtgtgtgggtgggggtattgttgattttatatttaaatagatttacgtcggggttgtttaggagggtgattttgagagatatgaaagtattgagggggaaagatagagaaaataaagatagagagaagttgagagagttagggagtagtttgagatatggggagggagggggaggagtaggagggaaggcgatagatataatttaggagtaggagaggaagttaagttatagagataatatgttgagagagtagaggagattttttaggtaagggtagattttttgtaggggtaggttgggggttttcgttgtttgttgggttaggttggtgaatttggttatggtttcgttttttagatttattttttaggtgtgtttgtttattggttttttattgttttgtttaaatgttttaattttataaatttcgggatttcggggtgtagattattttttttagatttttgagtttgtgtttggttatgggtatttttagtatttttttttgcgtgttgtttttttgtggggtattgggtaagggtgggttggggaatttttagtggttagggggttgggggtggggataagggtatgtggaggaatttgagggttggggaggagaggggtgtgggtgttggaagaggttaagaagagagttgggggagtgggggattttagggagattagttattgggaaggttagtttgatgaggtgggaaaggaagagtttttttttaaggtatttgagaataattgttttttttttgttgtatttttgattcgtttttgttttttttattttttattttacgtgttgtttttgtgttgggttttttggttaatgttaatttttatttttttatttgtttttggtgttatttatttaatttttttattgatttttttaatttttttgttgttgggtttggttttttgttttattttttttatgttggtttttgatttttgtggtttttgtttatgtttgcgtattttttaatttttgtattttttttgtttttatttttgtttttttttttgtatcgtttttttttttttttttgagatagagtttcgttttgttatttaggttggagtgtagtggtatgatttcggtttattgtaattttagttatttagatttaagagatttttttgttttagttttttaagtagttgggattagaggtatgtgttattatgttcggttaattttttgtatttttagtagagacggggttttattgtgttagttaggatggttttaattttttgattttatgattagttcgtttcggttttttaacgtgttgggattataggcgtgagttattgcgtttagttattttttttatttttgttagttttttttttttattttatagtttttttttttttgttttatgtgttatttttttttgtgattttttttcggatttggtttttgtttgttttatagggagggtttgttttttttgtttttttaatttttgttgttttaataggttttattatgttttttgttcggggaaggtttcgttgttatatttgtggttttattaaattttgttattttgtttttatcgagtgtcgggacgatgaagtttgtggtattagtattggtattttaggtaggattttggtttaatggtttttttttaggaggttttttatttttatttattcggttttttttgtggttttcgttttagtatgttttttttattttatagattagagtgagattattgagtgaaaaagttgttttttaagggtttagtgttttttgttaggttatgttatttattggttgtatttttatattttgtggtattattgttgcgagtaggatttgtgtaatatagtcgtttttttatagtagtttattagttttttcgtttttttgtttttttttgtggttagtttcgttgggagaggatattttttttattagttttcgtggatttgtagtttttaatttaggatatttttcgttattattgcggttttggaaatatttgtatagatattttgagatatgttcgagaatttaattttgtatagagattttagattttttagtagattttttatagattttttataaggtttggggaggtatttgtttagagtttaattttataaagaatatttattttgcgttttttgttttttttagatgtttattgttgatgtttcgtgttagtttaggttattggtaaggtaggtattttgatgatattgtggattttaggtaaggggattaaaggagtattaggtatggtaaggaggagagttttgttaggaaagattaatgtggtaggtcgggaatttaggatggagggtttgggggattatgaagagtatttttaataaaaggtttatttaggagtttagtaatattgtagatattgtagtgtgtgtgtgtgtgtgtgtgtgtgtgtgtgtgtgtgtgtttgtgtgtgtgtgttttaagagtaaattgtagttgtttggtgggttgggttggagttggaatttggattacggtattttttttattttttatttgtgttattttcgtttttttttttgttaatggtttagtttaagtttttgtagtttgaaggttttaggtgagatttttgagaaagtttttttttagtaaggtttaagtttgagtagagatataaaagggtatttagtggagttgtttgtgagggtgtggttggagtttagtttatttttgtttgagattagggaatggttaagttgggagtattaatattttttttcgttttattagtttagattcgtttatggtttatagatattttagtatggtttcggtttaataaataatatatttttattgggtttgttagtttgagtagatattttttttgttttcgagaaatagggtgtgattttagggtagtaggaaggaagtgttagagtggcgatagttgtttatatgttttgaatgtttcggtaaggcgttatagggaagagtgtgtgtttaggataaggaaggataaggagggggtttcgggtgggagttgagtataggtatttttattttgatttagttttttttttttgtatgtgaggaagtttggggttgattaaatatgtttgtttttttttttttttgtgaggatgagatatggggtagtgggggtttggtttaatttagagatgggttgaggttttttattttttttgtttttttatttttttattttgtgtttttatttttttttttttgtttatttttttttattttttttgatttgagttttttttttttttttttttttttcgttttttttatttgttttttagttttattgtaatggattttttattattgtttaagtttttagatttttgttttttttttgtgtatatttattttttttgtttttattagtaattttaggttttttttaattttatagtattatgggtttagggttatttttttattgttgttataagataggagattaaatttttttgtaggttatattatagaataatgtttttttttttttttagttttttatttttttttatatatagtttggtggttgttggaggttagttggatggtgaagtcgaatttttagtttcgttttttttgttaaggttgtcgaggaattttttaggtgttagatggttagcgagatagtaggttatattttttagtagatgttattaaaattatttgggtttgtgggtaggtgggttgtggggttttttagagagatagattaaggatatttttattttttatatttttaggaacgagggtttatttttaatttaattcgtgttttttttttatttttagttttttttaggatttaagtttttgttttttagttgttttttatttaagacgggttaaatggatgtttttatagatttggatttcgggtttgaattgaggaatcgaggtatttggggagaaggag

SEQ ID NO: 110 - DNA, 5477 bp, Artificial Sequence
  Chemically treated genomic DNA (Homo sapiens)
ttttttttttttagatgtttcgattttttagtttaaattcgaaatttaggtttatgagaatatttatttggttcgttttgggtgaggaatagttagggaatagaggtttaaattttggaggggattggggatggagaggaaatacgggttgggttggggatgggttttcgtttttgaggatgtgaaaagtagaggtatttttaatttgtttttttggaaaattttatagtttatttgtttataagtttaggtgattttggtgatatttgttgggaagtgtgatttgttgtttcgttggttatttggtatttggaagatttttcgataattttagtaaggggggcgggattgagagttcgattttattatttagttggtttttagtagttattaagttgtgtatggggaggggtgggggattgaaggaaaggaggagtattattttgtgatgtaatttataaaaaggtttggttttttgttttgtagtagtagtggagggatggttttgagtttatagtattgtggggttgaggggagtttgaggttgttggtgggggtaaggaggatgggtgtgtatagggaggagataggaatttggagatttgagtaatggtggggaatttattgtagtggagttgaaggataaatggggaaaacgggggaagagagagaagggaagagatttaagttagagaaagtggaaagagatggatagagggagaaaaatagaagtataaagtgggaggatggagggatagagaaaatggaaagttttaatttatttttaaattaagttagatttttattattttatgttttatttttataaagaagagagggaataggtatatttaattaattttagatttttttatatgtaaggggagggaattgagttaggatagagatgtttgtgtttagtttttattcggggttttttttttatttttttttattttaggtatatatttttttttgtggcgttttatcggggtatttagagtatgtgagtagttatcgttattttggtattttttttttgttgttttgaggttatattttatttttcgggggtagagggagtgtttatttaggttggtaggtttagtgggggtatgttatttattgggtcggggttatgttgggatgtttgtgaattatgggcgagtttgggttggtgaagcgagggagggtattgatgtttttaatttggttattttttagttttaggtagaaatgagttgagttttagttatatttttataagtagttttattgggtgtttttttgtgtttttgtttaagtttgggttttattggaaaaaagtttttttagaagttttatttaaagtttttaggttgtaggggtttaaattaagttattggtaagaaaaaggacgaaaatgatatagatggagaatgaggggagtgtcgtggtttaggttttagttttagtttaatttattaagtagttatagtttgtttttagagtatatatatatagatatatatatatatatatatatatatatatatatatatattgtagtatttgtagtattattggatttttagatagattttttattaaaggtattttttatagttttttaagttttttattttgagttttcgatttattatattagttttttttagtaagatttttttttttattatatttgatgtttttttgatttttttgtttgagatttatagtgttattaaaatgtttgttttgttagtgatttgggttgatacggggtattagtaatgggtatttagaaaagataaaagacgtagaataggtgttttttatgaggttggattttgggtaggtgtttttttaggttttgtgaggggtttgtgaggggtttgttgagagatttggggtttttgtataaaattaggttttcgggtatgttttaaagtgtttgtgtaggtgtttttagggtcgtagtgatggcggggggtattttgggttgggggttgtagatttacggaagttagtggaggaggtgtttttttttagcgaagttggttataaagaggggtagggaggcgaggaggttggtgagttgttgtggggaagcggttatgttgtataggttttgttcgtagtagtggtgttatagagtgtaggagtgtagttagtaggtggtatagtttggtagagggtattgggtttttgagaggtagtttttttatttagtgattttattttggtttgtgggatgaaagaggtatgttgaggcgggggttataggaaaggtcggatggatggaggtagggagttttttggagaagggttattggattagagttttatttgaagtgttaatattgatgttataagttttatcgtttcgatattcggtgggaatagggtggtagggtttggtgaagttatagatgtagtagcggagtttttttcgggtaggggatatggtgagatttgttgaggtagtagagattaggagagtaggagaggtaaattttttttgtggggtaggtagaggttagattcggagagggattatagagagaggtgatatatgaagtagagagaggaaagttgtggaataagggaggaaagttgatagaagtagaaaaaatagttgggcgtagtggtttacgtttgtaattttagtacgttgggaggtcgaggcgggttgattatgaggttagaagattgagattattttggttaatatagtgaaatttcgtttttattaaaaatataaaaaattagtcgggtatggtggtatatgtttttagttttagttatttgggaggttgaggtaggagaattttttgaatttgggtggttgaggttgtagtgagtcgagattatgttattgtattttagtttgggtgatagaacgagattttgttttaaaaaaaaagagggagacgatgtaggaaaagaaatagagatggaggtaagaggggtatagggattgagagatgcgtagatatgaatagaagttataagaattagagattaatataaaaagagtgagataaaaagttagatttagtagtaggaaagttgagggggttagtgaaaaagttaagtaaatggtattagagatagataggaaaatagaaattgatattgattaaagggtttagtatagaagtaatacgtgaaataagggataggggagataggggcggattaaagatgtagtaagggggagatagttatttttaaatgttttgaaaggaaatttttttttttttattttattaggttggtttttttagtggttggtttttttgaagttttttatttttttagttttttttttggttttttttagtatttatattttttttttttttagtttttaggtttttttatatgtttttgtttttatttttagttttttgattattgaaggttttttagtttatttttatttagtgttttatagaggaatagtacgtagaggaagatgttggaggtgtttatggttagatataggtttaggaatttgggagaggtgatttgtatttcgagatttcgggatttgtagagttggagtatttgagtaagatagtgaggaattagtaaataaatatatttagggagtgaatttggggggcggaattatgattagatttattagtttgatttagtaggtagcgggggtttttagtttgtttttgtaaggagtttgtttttgtttggagggttttttttgtttttttagtatgttgtttttgtaatttagtttttttttttgtttttgagttgtgtttgtcgtttttttttttatttttttttttttttttttatgttttaagttgttttttggtttttttagtttttttttgtttttgttttttttgttttttttttttagtgtttttatgttttttaaagttatttttttaaatagtttcggcgtggatttgtttgagtgtagaattaataatatttttatttatatatttatatgtatatataaagtttagttgtgtaagggcggattttatttagttttagatttttttgatttttttaagttttaatatttttattttgtaattatttttgttagttttattattttggaggaaagaaataattacgggtggggttggagggtttgttgatgtgtttgtattggggagaaattattagaaaggaaggtatggatgggatttggggtaggggggtggtgatatagtttggaaggttggggttgaagagattgggaaggaggaaggtttatttggggaattagagttagtatgtattaggaggagtaagattaggaatagggagtgaagataggggagatataggtgtttaggagagtagttttttttaaaaatattgattttaggatttttttatattttttaaagttatttaagattttgaagagtttttttttatgaggttatattaatatttattatattaaaaattaaaatagaaaatttaaagtaggtatttattgatttatttaaataataaaaataataaagtattatatgttaataaaatatagttttgtgaaaaataattattatttttttatagtatagtgagaagttgagtattgttttatatttttgtgaatttagtgttaggtttcgtgggagatgtttgggtttttttatttgtttttgtatttagtttgttgggatatgttgttttcgttgaagtttagtatatgaagaaaatttgattttatatagatagttgtaaaaggaggatttttaaggattttgtgaaagggtattagggatttttaggggtttttgttggtttatagattgttgttgaggataaaggagtttgaggattttagaggatgttgagagtatgttgtggggtttttttttgtttttattggggtttttggtgtttgttgggggagatttttttttttttttttatagttttataaagtttaaggtacgggggatataaggtaggtagagtcgggttggggaggggggtgggtaggaggtagaggcggttttgatacgggtagattgcgatgaaattttagtttgttgggattttgtttagttttttgttaggggttgttttgggtaaggaggcggttagttagttttttatataggttttttgttagtcggttttatcgagggtttaggtttagcgtttttttttttttgttaggaaatcgaatgcggtgttataattgtggtggaagttttagtagtttttgtaaagaggtcgtgattatttgtggcgagggtagattttagttaggtttggaatagattaagttatttggaaatcgtgagtttttagttttttttttttttagtagtttttttttgtttttagttttatgttaatttttttggtttttagaattttttaggtttagtttggttttgggtagatggtgtagttgttagaggagagtagtttgtattttttttggtttttggtacggagtttttgagaggtttatagtttttgtg

SEQ ID NO: 111 - DNA, 6944 bp, Artificial Sequence
  Chemically treated genomic DNA (Homo sapiens)
gaagttttataagatcgaagtggagttattggagtgttttaggtgaagaaacgatatattttgatttatagtagtaggattattgtggagagaatatttaggtggtaggtaatggaatagtgttagagttattatttaggagtgatagagtggtggggattaagggaagaggagggtttgagggatgagagggacggagggaagggttggagaagtaggaggtgaggagaaggagtagagggatagaatttgaaagtagtagaatttttagttttaaatatattgttttataaatttttaatatatttatttatagagtttagtagggtgttttttgtatttggtttttaatattttatgtgggattgtttaaaaattaattgttttttttgtttttttttaggtttaaaaaaatattaagtgttttaataaaatatgtatattatttagatgcggatattttttaaaaataggaagtgtatgagtattggtgaggggtattgtgattgcgttgaatatttgtaattttgaggtgaatgaatgtattggtttttggttgtaatatataattatacgttgtgttattttgtattgttaggagatgttttggatttttatagaaatttagggttatggaatgaaggtaattttagaatataataagagttatagatatatagtttgggaaagtaaaatttaggagttttgagagttgtataattgtaatgtatttagatatatttatatattaaggggttaaagtaatagtttttatatataagatttttgattggtcgggcgcggtggtttatgtttgtaatcgtagtattttgggaggtcgaggcgggaggattacgaggttaggagatcgagattattttggttaatacggtgaaattcgtttttataaaaaaattagtcgggcgtggtggcgggtatttgtagttttagttattcgggaggttgaagtagaagaatggcgtgaattcgggacgtagagtttgtagtgagtcgagatcgcgttattgtattttagtttgggcggtagagagagatttcgttttaaaaaaaaaaaaaaaaaaaaaaaaaaaaaaaaaaaaaaaaaaaaggtttttgataatttaggggttattaagattttattatttattgtagttaataaaaaaaaaaaagaaagaaagaaattggtttttgttttattttatatgtttaggtataatttttttagagaagaagaggaggggggcggggaggagtaggaggaggaggaaagaaggaggagaaggagaaggagaaggagaaggagaggaagaggaagaggaagaggaagaggaagaagaagaagaagaagaagaagaagaagaagaagaagaagaagaagaagaagaagaagaagaagaagaagaagaagaagaagaagaagaagaaaaggaagaagaagaaattgtttttatatttttatttttaggataagtttattgtttggtattaagttttttggggtgaatttttttttaaaagagttcggggagtttaggtatggaatgggaggtagaaagtttaattaagggattgggatttcggaatgaataatgaagggagatggattgggtttatgtcgaaggtttttttttggttttttagttttcgggcgaagatttagggagatattgagatatattttgtataggagggggagggggagggggagggtaaagttttagggttttaggagtggtttttaagggtttaggtttcgaggcggtgtttggggttgggaggtttagtattgagaattttttatttttttagagttttttttttttttttaattcgtgttaggtttttttttttggatatttataacgcggttttattttttatttttattgggcgtcgcgtttttagagaagttaattagtgtcgtcgtagtttttaggttttaaagttttacgtatttcgcgggatttatattttttttagacgcggaggttggggttatggcgtttcgaagtttttttttgttgtttttaggggttttggttttgatcgatatttgggcgggtgagtgcggggtttagagagaaacggtttttgtggggaggagtgaggggttcgttcggtgggggcgtaggatttagggagtcgttttcggaggagggtttggcgggttttagttttttttcgtttttaggtttttattttttgaggtattttagtatcgttgtgtcgcggttcggtcgcggggagtttcgttatatcgtcgtggagtacgtagacgatacgtaatttttgcggttcgatagcgacgtcgcgatttcgaggatggagtcgcgggagtcgtgggtggagtaagaggggtcgtagtattgggagtggattatagggtacgttaaggttaacgtatagattgatcgagtggttttgaggaatttgtttcgtcgttataattagagcgaggttggtgagtgaattcggtcgggggcgtaggttacgattattttttattcgttacggatcgttcgggttttttagagttttcggattcgaaatttatttcgaggtagcgggattcgtttagattttttattcgggagagttttaggcgtttttatttaggtttatttttagtttaggttaaaattttcgcgggttgggcggggagggggcggggttagttgggcggggttgattgcggggatcggttagggttttatattttttagggaatgaatggttgcgatatggggttcgacggacgtttttttcgcgggtattattagtacgcgtacgacggtaaggattatatttttttgaacgaggatttgcgtttttggatcgcggcggatatcgtggtttagattatttagcgtttttatgaggtagaggaatatgtagaggagtttaggatttatttggagggcgagtgtttggagttgtttcgtagatatttggagaatgggaaggagacgttatagcgcgtaggtattaggggttatgggcgttttttttattttttgtagattttttgggatggtttcgtataaggttgggaggaaagtggatttaatgttaggatatcgttttttttttagttttgagtaggaagaatttttttggttttcgagattcggtattagagagtgattgtgagagttcgttttgttttttgggataattaagggatgaaatttttgagggaatggagggaagatagtttttggaatatcgattcgcggttttttttgagttttttaatagttttgggtttcgtgattttttttttaagttttgttttttgttttatatttaatgtgtttgaggttttgattttagtttttcggtttttatttaggttagggttagaagtttttgttttttttttagagattttaattttttaaggaataggagatttttttaggtgtttgtgtttaggttggtgtttgggttttgtgtttttttttttattttaggtgttttgtttatttttaggttggttatatgggtgttgttggggttttttatgaggagtgtaaagtgtttgaattttttgattttttttagattttttaaaggtatacgttgtttattattttatttttgattatgaggttattttgaggtgttgggttttgggtttttattttgcggagattacgttgatttggtagcgggatggggaggaatagatttaggatatagagtttgtggagattaggtttgtaggggatggaattttttagaagtgggtcgttgtggtggtgttttttggagaggaatagagatatatatgttatgtgtagtacgaggggttgttttagttttttattttgagatggggtaaggagggagatgggtaaagaggggaacgaggggttatgtttttttttagggaaagtaggagtttttttggagttttttagtagggttagggttgaggtttggagattagggttttttatttttttttttttttttagagtagtttttttagtttattatttttatcgtgggtatcgttgttggttttgttgtttttggagttgtggttattggagttgtggtcgttgttgtgatgtggaggaagaagagtttaggtaggaaggggtgaggagtggagtttgagtttttttgttttattgggggttgtaagttttaagtagaagtgtgttttgttttattattgggaagtattatttatatttatgggtttatttagtttgggttttgtgtgttagtatttatttatttgtaaagtttttgtgaaaatgaaggatagattttttatttcgatgattatggtggtgatgggatttgattttagtagttataaattataggggaaggtttttgttgatgatagattttaggagggtagttggtttaggatttatatttgttttttttatattttttgattttgttttggatttatagttatatttttttggaaatttttttgggattaaagattaggggtttgttttaggattttatggttttgttttttttttggttttttataggatattttttttttatagatagaaatagagggagttatttttaggttgtaggtaagatgaaggaggttgatttttgagattgttgggatattgtggttaggagtttatgagggagtttatttattttatagtttttttagttatatttgtgggttttgattaggttttgtttttgttttattttaattattgatagtgtttagggttttggggtgttttttatagttaataaaggtgatattttagggtaggggttttgatgtgagtggggtgttgggggggaatagaggggatttagttgtgttattgggtttttttgatttggatgttttgagtatgaaatgggttatttagagtgttattttttattgtgattgatacgaatttgtttatgaatattttttttatagtgtgagatagtttttttgtgtgggattgagaagtaagatattaatgtagtagaattgtatttgtgttttacgaatatatataaattttaaaaataaagaataaaaatatatttttttatagatataggtagatatgtttttatagtatgtacgtaaatgtgtgtgtgtgtgtgtgtgtgtgaagagaaagagtgaatagagagattaagatttttttaatggtgaaaagatatatatatatttggaattagttagtttgatttagtttaggtgattttaattttggtggtaataattaaagtatcgtagttaggagttagtcgaatatatgtttttttttttttattagattgaattagagtgttgattttggttatattaatgttataaatttttttatagtttgtttgatttggtgtttgttggttttaatatttatagtgaatataagtaggttgttgttttttattttttttatagtttatttagtggttagcggaaatttgatgataatatggtggttaagtttattttttttgggggtgtttttttaaggatatttgggttgttttcggagttatagtgttttgggtcgtcggaaggtgggtgatatgtggattttgttttttttgtggttgtggatattttttaatattgtttttttggttttgtaaagttttcgttttggtttcggttttaggaggggtaggagttttttttttcgtttttggtattattttatgaaaagggtttagattaagatttttgattgagttattttaaagtaagttgtaagatttatgatattagattattaaatattttattatatattttttaagaataagaattaatattattatattaaagaaaataaataattttataatattatttaaagtttttttatgtttaaatatttttattttttttagtatatttttgtatttattttttatagtttgtttttttaaaatgtttattcgttgtttttggttatgtttttttaattatttataatttataataattaatttatttttttttttttagaatggtattatttgttttagagatgaggttaaatatttgtggaattttttttatattgaatttattatattattttttttgatgtttttaattttttttttttaattgttatgttttttaaggatttatgtagttttgggttaaatatttggtagtaatgtttataggaggagttgtgatcgtatatttattatattaggaggtatataaagtttagggttattaggattttttttgattttatatagttaaatttattttgattttttagagatgtagaattatgggttgggtgtttagtgggtatgagtgtgatattttggtaataggaggttttgttattttttttattttttacgagttttagttttttatattttgaggttttgagttttagatttttaattattaggttaggtttttttagatttagattttttttttgttttttttagttttattttgttttgtatttattttcggattattttttttttataggtttagtttttgagtgtttttattttttaaataagtatttttatttaggagtaatttttttattagaggatattagttatgtttggaaaaatgttttgttgttatgattggagtgaggaggaggtgttattagtattttgtggggaatgattagggatgttgaatattttgtagtgtataagttagtttaattatttatataatagataattatttagttttaatattaagattgttaagggtaaggaggtttgttaggatttttttttttttgagtataagtttttttgaattgagggatattttgaaggaaaagtgtggttttattttagttattttttttttttttggagttttatttgtatgtttgtagtgtttaggtttgtaatttggggtttaggaatttatttttttatgagattgtatgtagaagtgatgatatgtgtatata

SEQ ID NO: 112 - DNA, 6944 bp, Artificial Sequence
  Chemically treated genomic DNA (Homo sapiens)
tgtgtgtatatattattatttttgtatgtagttttatgggaaggtgggtttttggattttaggttataggtttaagtattataggtatatagatggagttttagggaagggagagatgattggggtgggattatattttttttttagggtgttttttagtttaaggaagtttgtatttaagggagagaaagttttggtaggtttttttatttttggtaattttggtattggggttggataattatttgttatgtgggtgattgggttgatttgtgtattgtaggatgtttagtatttttggttattttttataagatgttggtagtattttttttttattttagttatggtaataaaatatttttttagatatagttaatgttttttggtgggaaaattgtttttggatgagaatatttgtttgagaggtagagatatttaggagttgggtttgtagagggaaagtgattcggaagtagatataaagtagagtggggttggagaagataggaagggagtttaggtttggaggggtttggtttgatggttgaaggtttggagtttagaattttagggtatggggaattaaagttcgtgaggaatggggagagtggtagaattttttattgttagaatattatatttatatttattaaatatttagtttatggttttgtatttttgggaagttaggataaatttggttgtatggggttagaaagagttttggtaattttaggttttgtgtgttttttgatgtgatgaatgtgcggttatagttttttttgtaaatattgttgttaaatgtttaatttagagttatataggtttttaggaggtatagtagttagaggaaaaaagttaaaggtattaggggaaataatatgataaatttagtgtggagaagattttataggtatttggttttatttttgaaataggtaatgttattttaaaagaaaaaagatgggttgattgttatagattgtaggtaattaaagaaatataattaaaggtaacgagtggatattttaagaaaataagttataaaaaataggtataaaaatgtattgaaagaagtggagatatttgaatataaaaggattttaaataatattatggaattatttattttttttggtgtgataatgttggtttttatttttaggaggtgtgtgatgaagtatttagtggtttagtattatgggttttgtaatttattttagaatgatttagttaaaaattttaatttggattttttttataagatggtgttaagaacgaagaaggaagtttttgttttttttaaagtcgaagttaaagcgaaggttttgtaaggttaagaaggtagtgttgaaagatgtttatagttataaaaaaaataagatttatatgttatttatttttcggcggtttaagatattgtgatttcggaggtagtttaaatatttttggaagagtatttttaggagaaataagtttgattattatgttattattaagttttcgttgattattgagtaggttgtgaagaagatagaaaataatagtttatttgtgtttattgtggatgttaaagttaataagtattagattaaataggttgtgaagaagtttgtgatattgatgtggttaaagttaatattttgatttagtttgatggagagaggaaggtatatgttcgattggtttttgattacgatgttttggttgttgttattaaaattgggattatttaaattgagttaagttggttagttttaaatatatgtatatttttttattattaaaagaattttaatttttttatttattttttttttttatatatatatatatatatatatatttacgtgtatgttataaaaatatatttatttgtatttataaaaagatatatttttattttttatttttaaaatttatgtatgttcgtgaggtataagtgtaattttgttatattgatattttgttttttagttttatataaggaagttgttttatattatagagaaaatatttatgaataaattcgtattagttatagtgagaggtaatattttaaatagtttattttatgtttaagatatttaagttaaagaaatttaatagtatagttgagttttttttgtttttttttaatattttatttatattagggtttttgttttggagtgttatttttattagttgtgagagatattttagagttttgggtattgttagtgattggggtagaataaaaataggatttggttagagtttatagatgtggttagaggaattgtggggtgggtgagtttttttataggtttttgattataatattttaataattttagggattagttttttttattttatttgtagtttgagagtagttttttttgtttttatttatgggaagaaaatgttttgtgagaggttagaaaggaggtagggttataaggttttagagtaaatttttagtttttgattttagagaagtttttagaaaagtgtaattgtagatttagggtaggattaagaaatatgaagaaagtagatgtgggttttggattaattgtttttttgaggtttgttattagtagggatttttttttgtgatttgtgattgttgggattaggttttattattattataattatcgaagtgaagaatttgttttttatttttataggagttttataaatgagtaggtgttggtatatagggtttaggttgggtagatttatgagtgtggatggtgttttttagtaatgaggtagggtatatttttatttggggtttgtaatttttagtgggataagaaaatttagattttattttttatttttttttatttgagtttttttttttttatattatagtagcgattatagttttagtgattatagttttaaggataataaggttagtaacgatgtttacgatggggatggtgggttggggagattgttttgggaaaggaagggaaggtgaggggttttgatttttaggttttagttttgattttgttgaagagttttagaagggtttttgttttttttgagaaaagatatgatttttcgtttttttttttatttatttttttttttattttattttaggatgaggggttggggtagtttttcgtgttgtatatggtatgtgtatttttgtttttttttaggaggtattattatagcggtttatttttggaaggttttattttttgtaggtttggtttttataagttttgtgttttgggtttgtttttttttatttcgttgttaggttagcgtgattttcgtagggtagaagtttagggtttagtattttagggtggttttatggttagagatggggtggtgggtaacgtgtgtttttggaggatttgagaagagttagaaaatttaggtattttgtattttttatgggaaattttagtagtatttatgtgattaatttgagaatggataggatatttggggtggggaagggagtatagaatttagatattagtttggatatagatatttgggaaaattttttattttttggaaagttagagtttttgaggggggagtagggatttttggttttgatttaagtggaggtcgagggattggaattagagttttaaatatattgagtgtgaggtagagaataaaatttgagagaaaagttacggggtttaaggttgttggagggtttaaaggggatcgcggatcggtattttagggattgttttttttttatttttttagaaattttattttttaattgttttagagagtagggcggatttttatagttattttttggtatcggatttcgaaagttaggaagattttttttatttaggattagagggagggcgatattttagtattgggtttattttttttttaattttgtgcgaggttattttaagagatttataggagatagggaaggcgtttatggtttttggtatttgcgcgttgtagcgttttttttttattttttaagtatttgcggagtaattttaggtattcgttttttaggtaggttttgaatttttttgtatatttttttgttttatagaagcgttgggtgatttgagttacggtgttcgtcgcggtttaggagcgtaggttttcgtttagggagatgtaatttttgtcgtcgtacgcgtgttggtgatattcgcggaggaggcgttcgtcgggttttatgtcgtagttatttattttttggagggtgtgagattttagtcggttttcgtagttagtttcgtttagttagtttcgtttttttttcgtttaattcgcggggattttggtttaaattgaaaatgaatttgggtaaaggcgtttgggattttttcgggtggagggtttgggcgggtttcgttgtttcggggtagatttcggattcggagattttgagggattcgggcggttcgtggcggatggggggtggtcgtgatttgcgttttcggtcgggtttatttattagtttcgttttggttgtagcggcggagtaggttttttagggttattcggttagtttgtgcgttggttttggcgtattttgtggtttatttttaatattgcggttttttttgttttatttacggttttcgcggttttattttcggaatcgcggcgtcgttgtcgaatcgtaggaattgcgtgtcgtttacgtattttacggcgatgtagcggggtttttcgcggtcgggtcgcgatatagcggtgttgaaatattttaaggagtgggagtttgggggcgaggaggggttgagattcgttagattttttttcggaggcggttttttgagttttgcgtttttatcgggcgggttttttatttttttttatagaggtcgtttttttttggatttcgtatttattcgtttaagtatcggttagggttagggtttttgagagtagtaggaggaggtttcggggcgttatgattttaattttcgcgtttgggaaaaatatgagtttcgcggggtgcgtgggattttagaatttgggaattgcggcgatattgattggtttttttagaaacgcgacgtttaatgggagtgagaaatggggtcgcgttatgagtatttaggaagaaggatttgatacgggttgggagagaaagagaaattttggggagatggggaatttttaatattgagttttttaattttagatatcgtttcggggtttgagtttttgagagttatttttggggttttgggattttgtttttttttttttttttttttttttgtgtagggtgtgttttaatgtttttttgagttttcgttcgggggttgagaaattagggagaaattttcggtatggatttagtttatttttttttattatttatttcgaaattttagttttttgattgaattttttgttttttattttatatttggatttttcggatttttttggaagaaaatttattttaaggagtttggtgttagataatgaatttgttttgagaatgaaggtgtagagatagtttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttgttttttttcgttttttttttttttttttttggaaaagttgtatttgagtatatgaaataggatagagattagttttttttttttttttttttttttattagttgtagtgagtagtagaattttggtaatttttgaattattaggaattttttttttttttttttttttttttttttttttttttttttttttgagacggagtttttttttgtcgtttaggttggagtgtagtggcgcgatttcggtttattgtaagttttgcgtttcgggtttacgttatttttttgttttagtttttcgagtagttgagattatagatgttcgttattacgttcggttaatttttttgtagagacgggttttatcgtgttagttaggatggtttcgattttttgatttcgtgattttttcgtttcggttttttaaagtgttgcgattataggtatgagttatcgcgttcgattaattaggaattttatgtgtaaaaattgttattttggttttttgatatataaatgtgtttaaatgtattatagttgtataatttttagagtttttaagttttgtttttttagattatgtatttgtgatttttgttgtattttaaaattatttttattttatagttttgagtttttgtgggagtttaggatattttttgataatataaagtagtataacgtgtgattgtatattgtaattaggagttaatatatttatttattttaaagttgtaagtgtttaacgtagttataatgttttttattagtgtttatgtattttttgtttttaggaagtattcgtatttaagtggtgtgtatgttttattggaatatttagtatttttttaaatttgaaaaaaagtagaaaaagtaattaatttttaggtagttttatataaggtgttaaaggttaaatgtaaggaatattttgttaggttttgtagatggatgtattaaaaatttataaaataatgtgtttaaagttaagaattttgttgtttttaaattttgtttttttgttttttttttttattttttgtttttttagttttttttttcgttttttttattttttaggtttttttttttttttagtttttattattttgttatttttgaatagtggttttagtattgttttattatttgttatttgagtgttttttttatagtggttttgttattgtgagttaaagtgtgtcgtttttttatttaaaatattttagtggttttatttcggttttgtgaagtttt

SEQ ID NO: 113 - DNA, 19 bp, Artificial Sequence
  TGFA primer 1
ggtttgtttgggaggtaag

SEQ ID NO: 114 - DNA, 18 bp, Artificial Sequence
  TGFA primer 2
ccccctaaaaacacaaaa

SEQ ID NO: 115 - DNA, 18 bp, Artificial Sequence
  TGFA detection oligomer 1
gtttttttcgttttagag

SEQ ID NO: 116 - DNA, 18 bp, Artificial Sequence
  TGFA detection oligomer 2
gttttttttgttttagag

SEQ ID NO: 117 - DNA, 21 bp, Artificial Sequence
  ADCYAP1 primer 1
ggtggatttatggttattttg

SEQ ID NO: 118 - DNA, 20 bp, Artificial Sequence
  ADCYAP1 primer 2
tccctcccttacccttcaac

SEQ ID NO: 119 - DNA, 20 bp, Artificial Sequence
  AFP primer 1
aggtttattgaatatttagg

SEQ ID NO: 120 - DNA, 20 bp, Artificial Sequence
  AFP primer 2
aacatatttccacaacatcc

SEQ ID NO: 121 - DNA, 20 bp, Artificial Sequence
  APOA1 primer 1
gttggtggtgggggaggtag

SEQ ID NO: 122 - DNA, 20 bp, Artificial Sequence
  APOA1 primer 2
acaaccaaaatctaaactaa

SEQ ID NO: 123 - DNA, 20 bp, Artificial Sequence
  APOC2 primer 1
atgagtagaagaggtgatat

SEQ ID NO: 124 - DNA, 20 bp, Artificial Sequence
  APOC2 primer 2
ccctaaatccctttcttacc

SEQ ID NO: 125 - DNA, 25 bp, Artificial Sequence
  ATP5A1 primer 1
agtttgttttaatttattgatagga

SEQ ID NO: 126 - DNA, 23 bp, Artificial Sequence
  ATP5A1 primer 2
aacaacatctttacaattactcc

SEQ ID NO: 127 - DNA, 20 bp, Artificial Sequence
  ATP5G1 primer 1
tgatagtttatgattgttga

SEQ ID NO: 128 - DNA, 20 bp, Artificial Sequence
  ATP5G1 primer 2
aatctcaaccctcaacttcc

SEQ ID NO: 129 - DNA, 20 bp, Artificial Sequence
  ATP6 primer 1
gggtattaggaatttatgtg

SEQ ID NO: 130 - DNA, 20 bp, Artificial Sequence
  ATP6 primer 2
caaaacaccttcctaactca

SEQ ID NO: 131 - DNA, 21 bp, Artificial Sequence
  C4B primer 1
attgataggtagttagattgg

SEQ ID NO: 132 - DNA, 21 bp, Artificial Sequence
  C4B primer 2
aaaaaactctcataaatctca

SEQ ID NO: 133 - DNA, 22 bp, Artificial Sequence
  C-ABL primer 1
ggttgggagatttaattttatt

SEQ ID NO: 134 - DNA, 20 bp, Artificial Sequence
  C-ABL primer 2
accaatccaaacttttcctt

SEQ ID NO: 135 - DNA, 20 bp, Artificial Sequence
  CD1R3 primer 1
attatggttggaattgtaat

SEQ ID NO: 136 - DNA, 20 bp, Artificial Sequence
  CD1R3 primer 2
acaaaaacaacaaacacccc

SEQ ID NO: 137 - DNA, 20 bp, Artificial Sequence
  CDC25A primer 1
agaagttgtttattgattgg

SEQ ID NO: 138 - DNA, 20 bp, Artificial Sequence
  CDC25A primer 2
aaaattaaatccaaacaaac

SEQ ID NO: 139 - DNA, 20 bp, Artificial Sequence
  CDH3 primer 1
gtttagaagtttaagattag

SEQ ID NO: 140 - DNA, 20 bp, Artificial Sequence
  CDH3 primer 2
caaaaactcaacctctatct

SEQ ID NO: 141 - DNA, 25 bp, Artificial Sequence
  C-FOS primer 1
ttttgagttttagaattgtttttag

SEQ ID NO: 142 - DNA, 23 bp, Artificial Sequence
  C-FOS primer 2
aaaaaccccctactcatctacta

SEQ ID NO: 143 - DNA, 20 bp, Artificial Sequence
  C-MOS primer 1
tttattgattgggagtaggt

SEQ ID NO: 144 - DNA, 20 bp, Artificial Sequence
  C-MOS primer 2
ctaattttacaaacatccta

SEQ ID NO: 145 - DNA, 20 bp, Artificial Sequence
  C-MYC primer 1
aaaggtttggaggtaggagt

SEQ ID NO: 146 - DNA, 20 bp, Artificial Sequence
  C-MYC primer 2
ttcctttccaaatcctcttt

SEQ ID NO: 147 - DNA, 20 bp, Artificial Sequence
  CRIP1 primer 1
tttaggtttagggtttagtt

SEQ ID NO: 148 - DNA, 20 bp, Artificial Sequence
  CRIP1 primer 2
ccactccaaaactaatatca

SEQ ID NO: 149 - DNA, 18 bp, Artificial Sequence
  CSF1 primer 1
tagggtttggagggaaag

SEQ ID NO: 150 - DNA, 20 bp, Artificial Sequence
  CSF1 primer 2
aaaaatcaccctaaccaaac

SEQ ID NO: 151 - DNA, 20 bp, Artificial Sequence
  CSNK2B primer 1
ggggaaatggagaagtgtaa

SEQ ID NO: 152 - DNA, 20 bp, Artificial Sequence
  CSNK2B primer 2
ctaccaatcccaaaataacc

SEQ ID NO: 153 - DNA, 20 bp, Artificial Sequence
  CTLA4 primer 1
tttttatggagagtagttgg

SEQ ID NO: 154 - DNA, 20 bp, Artificial Sequence
  CTLA4 primer 2
taactttactcaccaattac

SEQ ID NO: 155 - DNA, 20 bp, Artificial Sequence
  DAD1 primer 1
ttttgttgttagagtaattg

SEQ ID NO: 156 - DNA, 20 bp, Artificial Sequence
  DAD1 primer 2
acctcaatttccccattcac

SEQ ID NO: 157 - DNA, 20 bp, Artificial Sequence
  DAPK1 primer 1
attaatattatgtaaagtga

SEQ ID NO: 158 - DNA, 20 bp, Artificial Sequence
  DAPK1 primer 2
cttacaaccattcacccaca

SEQ ID NO: 159 - DNA, 20 bp, Artificial Sequence
  DBCC21 primer 1
atttggagttgaagtatttg

SEQ ID NO: 160 - DNA, 20 bp, Artificial Sequence
  DBCC21 primer 2
aactatacccaaacacctac

SEQ ID NO: 161 - DNA, 23 bp, Artificial Sequence
  EGFR primer 1
gggtagtgggatatttagttttt

SEQ ID NO: 162 - DNA, 18 bp, Artificial Sequence
  EGFR primer 2
ccaacactacccctctaa

SEQ ID NO: 163 - DNA, 20 bp, Artificial Sequence
  EGR4 primer 1
agggggattgagtgttaagt

SEQ ID NO: 164 - DNA, 20 bp, Artificial Sequence
  EGR4 primer 2
cccaaacataaacacaaaat

SEQ ID NO: 165 - DNA, 24 bp, Artificial Sequence
  ELK1 primer 1
aagtgttttagtttttaatgggta

SEQ ID NO: 166 - DNA, 20 bp, Artificial Sequence
  ELK1 primer 2
caaacccaaaactcacctat

SEQ ID NO: 167 - DNA, 26 bp, Artificial Sequence
  ERBB2 primer 1
gagtgatatttttattttatgtttgg

SEQ ID NO: 168 - DNA, 23 bp, Artificial Sequence
  ERBB2 primer 2
aaaaccctaactcaactactcac

SEQ ID NO: 169 - DNA, 20 bp, Artificial Sequence
  G6E primer 1
aggttggattttgggtaggt

SEQ ID NO: 170 - DNA, 20 bp, Artificial Sequence
  G6E primer 2
tctcctactctcctaatctc

SEQ ID NO: 171 - DNA, 22 bp, Artificial Sequence
  GP1BB primer 1
ggtgataggagaataatgttgg

SEQ ID NO: 172 - DNA, 20 bp, Artificial Sequence
  GP1BB primer 2
tctcccaactacaaccaaac

SEQ ID NO: 173 - DNA, 21 bp, Artificial Sequence
  HLA-DNA primer 1
gaggttaaaggaagttttgga

SEQ ID NO: 174 - DNA, 21 bp, Artificial Sequence
  HLA-DNA primer 2
aaactaaattctcccaatacc

SEQ ID NO: 175 - DNA, 22 bp, Artificial Sequence
  HLA-F primer 1
ttgttgtttttaggggttttgg

SEQ ID NO: 176 - DNA, 22 bp, Artificial Sequence
  HLA-F primer 2
tccttcccattctccaaatatc

SEQ ID NO: 177 - DNA, 20 bp, Artificial Sequence
  MLH1 primer 1
tttaaggtaagagaataggt

SEQ ID NO: 178 - DNA, 20 bp, Artificial Sequence
  MLH1 primer 2
ttaaccctactcttataacc

SEQ ID NO: 179 - DNA, 20 bp, Artificial Sequence
  HSPA1 primer 1a
agaggagatattttttatgg

SEQ ID NO: 180 - DNA, 20 bp, Artificial Sequence
  HSPA1 primer 1b
aaggataataatttgttggg

SEQ ID NO: 181 - DNA, 20 bp, Artificial Sequence
  HSPA1 primer 2a
aaaaatcctacaacaacttc

SEQ ID NO: 182 - DNA, 20 bp, Artificial Sequence
  HSPA1 primer 2b
cttaaatacaaacttaatcc

SEQ ID NO: 183 - DNA, 19 bp, Artificial Sequence
  IL13 primer 1
tttttagggtaggggttgt

SEQ ID NO: 184 - DNA, 18 bp, Artificial Sequence
  IL13 primer 2
ccttatcccccataacca

SEQ ID NO: 185 - DNA, 20 bp, Artificial Sequence
  L-MYC primer 1
aggtttgggttattgagttt

SEQ ID NO: 186 - DNA, 27 bp, Artificial Sequence
  L-MYC primer 2
cattatttcctaactaccttatatctc

SEQ ID NO: 187 - DNA, 20 bp, Artificial Sequence
  MC2R primer 1
atatttgatatgttgggtag

SEQ ID NO: 188 - DNA, 20 bp, Artificial Sequence
  MC2R primer 2
acctactacaaaaaatcatc

SEQ ID NO: 189 - DNA, 21 bp, Artificial Sequence
  ME491/CD63 primer 1
tgggagatatttaggatgtga

SEQ ID NO: 190 - DNA, 19 bp, Artificial Sequence
  ME491/CD63 primer 2
ctcacctaaacttcccaaa

SEQ ID NO: 191 - DNA, 21 bp, Artificial Sequence
  MGMT primer 1
ttgtgaggtattgggagttag

SEQ ID NO: 192 - DNA, 19 bp, Artificial Sequence
  MGMT primer 2
acccaaacactcaccaaat

SEQ ID NO: 193 - DNA, 20 bp, Artificial Sequence
  MRP5 primer 1
atgaggtgggaggattgttt

SEQ ID NO: 194 - DNA, 20 bp, Artificial Sequence
  MRP5 primer 2
catccaaaattctaaactaa

SEQ ID NO: 195 - DNA, 20 bp, Artificial Sequence
  N33 primer 1
tggaggagatattgttttgt

SEQ ID NO: 196 - DNA, 22 bp, Artificial Sequence
  N33 primer 2
tttttcaaatcaaaaccctact

SEQ ID NO: 197 - DNA, 23 bp, Artificial Sequence
  NCL primer 1
aagttgtgtttttaaaagggtta

SEQ ID NO: 198 - DNA, 22 bp, Artificial Sequence
  NCL primer 2
aaaaactaaacctacccaataa

SEQ ID NO: 199 - DNA, 21 bp, Artificial Sequence
  NEU1 primer 1
aggaggaagggttaataaaga

SEQ ID NO: 200 - DNA, 23 bp, Artificial Sequence
  NEU1 primer 2
atcttcctactactatctctaac

SEQ ID NO: 201 - DNA, 20 bp, Artificial Sequence
  NF1 primer 1
ttgggagaaaggttagtttt

SEQ ID NO: 202 - DNA, 20 bp, Artificial Sequence
  NF1 primer 2
atccaaactcccaatattcc

SEQ ID NO: 203 - DNA, 21 bp, Artificial Sequence
  N-MYC primer 1
ggaggagtatattttgggttt

SEQ ID NO: 204 - DNA, 21 bp, Artificial Sequence
  N-MYC primer 2
acaaaccctactccttacctc

SEQ ID NO: 205 - DNA, 20 bp, Artificial Sequence
  OAT primer 1
tggaggtggatttagaggta

SEQ ID NO: 206 - DNA, 18 bp, Artificial Sequence
  OAT primer 2
accaaaaccccaaaacaa

SEQ ID NO: 207 - DNA, 22 bp, Artificial Sequence
  POMC primer 1
agtttttaaataatggggaaat

SEQ ID NO: 208 - DNA, 19 bp, Artificial Sequence
  POMC primer 2
actcttcttcccctccttc

SEQ ID NO: 209 - DNA, 20 bp, Artificial Sequence
  PGR primer 1
agttgaagttataaggggtg

SEQ ID NO: 210 - DNA, 20 bp, Artificial Sequence
  PGR primer 1
aataaaaactctcaaaaacc

SEQ ID NO: 211 - DNA, 21 bp, Artificial Sequence
  RD primer 1
aagagtgagaagtagagggtt

SEQ ID NO: 212 - DNA, 21 bp, Artificial Sequence
  RD primer 2
ctactctctaaaactccaaac

SEQ ID NO: 213 - DNA, 20 bp, Artificial Sequence
  SOD1 primer 1
aggggaagaaaaggtaagtt

SEQ ID NO: 214 - DNA, 20 bp, Artificial Sequence
  SOD1 primer 2
cccactctaaccccaaacca

SEQ ID NO: 215 - DNA, 20 bp, Artificial Sequence
  TGFB1 primer 1
ggggagtaatatggatttgg

SEQ ID NO: 216 - DNA, 22 bp, Artificial Sequence
  TGFB1 primer 2
cctttactaaacacctcccata

SEQ ID NO: 217 - DNA, 25 bp, Artificial Sequence
  TNF-BETA primer 1
tttttgtttttgattgaaatagtag

SEQ ID NO: 218 - DNA, 20 bp, Artificial Sequence
  TNF-BETA primer 2
aaaaaccccaaaataaacaa

SEQ ID NO: 219 - DNA, 20 bp, Artificial Sequence
  TSP primer 1
tggtatttttgaggtagatg

SEQ ID NO: 220 - DNA, 20 bp, Artificial Sequence
  TSP primer 2
ccctatcttcctacacaaac

SEQ ID NO: 221 - DNA, 24 bp, Artificial Sequence
  UBB primer 1
ttaagttattttaggtggagttta

SEQ ID NO: 222 - DNA, 20 bp, Artificial Sequence
  UBB primer 2
accaaaatcctaccaatcac

SEQ ID NO: 223 - DNA, 18 bp, Artificial Sequence
  UNG primer 1
gttggggtgtttgaggaa

SEQ ID NO: 224 - DNA, 21 bp, Artificial Sequence
  UNG primer 2
cctctcccctctaattaaaca

SEQ ID NO: 225 - DNA, 21 bp, Artificial Sequence
  VEGF primer 1
tgggtaatttttaggttgtga

SEQ ID NO: 226 - DNA, 19 bp, Artificial Sequence
  VEGF primer 2
ccccaaaaacaaatcactc

SEQ ID NO: 227 - DNA, 20 bp, Artificial Sequence
  WT1 primer 1
aaagggaaattaagtgttgt

SEQ ID NO: 228 - DNA, 19 bp, Artificial Sequence
  WT1 primer 2
taactaccctcaacttccc

SEQ ID NO: 229 - DNA, 533 bp, Artificial Sequence
  APOC2 amplicon
atgagtagaagaggtgatatttgatggggaaggaagagtagggaggtcgggaagggtattaaggaataatattttattgtgggtttgcggagaatgggggattttaaggcgtgttagttttaggagggtgagggtaggagcgtgggtggagttagtaggtttttatgatggtttttattgagagtttcgtttttgttttttataagttttgattttatttttagtgggtatttagtatttttaatttttttatagtttttaatttagtttttgtcggaggcgaatttttagagtgagggttttttgttatttgagagaaggttttttgtgacgtgattttgggggacgttattgttttttttgtttttatttatttttttcgtagttttgttggttaggattttggtttagataaaggatgggggttgtggttgtggagcggaagtgggttttaattattataaattttttttgtgttcgttcggagttggtgaggatagtttgttagagtttggtaagaaagggatttaggg

SEQ ID NO: 230 - DNA, 707 bp, Artificial Sequence
  ATP5A1 amplicon
agtttgttttaatttattgataggatttttttagaatgaatttaaaaaagttgggaatttttaatttgagcgtagatcggattacgtggaacggtgttggtgtttgttaaaaatttagattgtttcgaattttcgatttagagggtttgaagtggggttaagatttgtagattaacgggtttcgtgggaggttttttgttggtggttagtttcggggtttagttgtttattgttgttattcgtgttaaattacggtttaatattatcgatattattaatcgttttggtttttaagatagtcgcgattttagacgggtgaggtttttattttttagtattagatggggtttgggaattgttgtttagtagatttagttatttacgtggttattcggggtaattataaggtcgatttaaaagattaaaataaatgtataacgaatgttaggattaaagtcggaatatatttaattatttattttgaggtttaaatttaaaaatgttatataaaaaaataagtaatttgttaaaaaatgtagagtggcggcgggggcggggggagaggtggtgaacgcgaggggtagtattttcgggttaggtgggtcggttgttttgattttttttgcggttcggttattttgttttagttagttcggaggttgcggttgtagaagtatcgtttgcggagtaattgtaaagatgttgtt

SEQ ID NO: 231 - DNA, 627 bp, Artificial Sequence
  ATP5G1 amplicon
tgatagtttatgattgttgaatatcggttgaggtttataaaattgcgtttatcgtttggggattttttagtcggtttttattttttatggaaagcggtttttttataaatttttacggtgggaattattgtaaaggtatcggttttttcggtttcgaatatttcgcgggattttagttgtttttgggtattttttttagcgtaattattaattttaatatgtaacgcgtttcgtggtttaagtattcgaatgaaggttcggggttaaagttatgtgtttgattgcgttatacgtttcgttattttttttacgtttttttttttagcgtatattttggtcgttattttgtgcgcgaggttatggaatttttgagtttcgttaattttatggtcgagcgttttagggatcggttaatcgtaatttagatttcgtaggaaagtttcgtttttattcgtatggaggcgggaattgttacgaagtttttgtggagggagaggaagtagttgcggaaagttaataagagtggggaatcgatgacgttaattaatggggacgcggggatattacggttaatgagaatggagaaggtttaggatacgtgggtgggggaagttgagggttgagatt

SEQ ID NO: 232 - DNA, 531 bp, Artificial Sequence
  DBCCR1 amplicon
atttggagttgaagtatttgttgtagaagatggatttacgtttttacgtttatattatttttattagtaacgagattcgtttcgatattttttttgattttcggtggcgtaagcgtatgttttttatttttaagagtaataagaatcgtatggattttatttatatggtgatcggtatgtttatgcgtatttgttagatgcgtaatagtagtttggattttatgttttttgtttatgttaatttttttagcgggagttattcggagggttggaatatgtttttcggggaatttggttatttacgttgggagaagattcgtttttaaaatagttagtgttataattggatttttttgttgggtaatcggtggaaaatatttttcgagacggtttatatttatttacgtagtcggattcggttatttattttattgcgaaatgagattggttagggtttcgtggatttgtcggatttttttaagaggtagttttatattaagattttagacgtgtaggtgtttgggtatagtt

SEQ ID NO: 233 - DNA, 966 bp, Artificial Sequence
  ELK1 amplicon
aagtgttttagtttttaatgggtatagatttggatttcgttttttttagtcgggtttttattttaggttgagtttagttatcgttaattaatgtagagttaggttttttttttttttaattttggtcgtagtttaattttgttttttgaaagtatttcgtttttgttatttaatgttttttcgtgtgtttgatagttattttgtttttttattttcgttgtgttttaaattcgtttttatttagttttatggttttgtttaatcgtagagttgttttgttcgtttacgcggagtttagttcgatttattttcgtcggttgttacgtttatttttatataagttttgttttcgttgagtagtatggcgtgcgatatcgtttttttggtgttttggtaggggtttagaagtttttcgttcgttaattagagaaaaatagggttatttattttcgtttttgggggttgttttttattaattttatgtaagttaattagtgtgaggtagattttcgttttttcgatataggtttcgagtttttttagttgtttatagttcgttagtttttgagttaatcggcgtggagtatcgtgaaggtcgaacgcgttttttcgggattttaggggtcgtgagcgttttattatttttttttacgttaattacggtatagttttgtagggaagggttcgttttttaatttttcgaggttttgcggtcgattaatagcgttttggttaattagcgagcggcgggatattgggtttttttttttcgggtttacgtgagttgtagggaaacgtaggggcggtttttaggtgttgtcgtcgttatcgttattattatttttatcgtcgtttcggaatttaggtttggggggcggtggggtcgcgtatggagttttcgtttttcggagttgttaatattgttaacgttatcgttacgttatatataggtgagttttgggtttg

SEQ ID NO: 234 - DNA, 685 bp, Artificial Sequence
  MC2R amplicon
atatttgatatgttgggtagtttatataagattttggaaaatattttgattatattgagaaatatgggttattttaagttacgtggtagttttgaaattatagtcgatgatattatcgattttttgtttgttttttttttgtttggttttatttttagtttgtttgtgattgttgcggatcgttatattattattttttacgtattgcggtattatagtatcgtgattatgcgtcgtattgtggtggtgtttacggttatttggacgttttgtacggggattggtattattatggtgatttttttttattatgtgtttatagtgattatttttacgtcgttgttttcgttgatgttggtttttattttgtgtttttatgtgtatatgtttttgttggttcgattttatattaggaagatttttattttttttagagttaatatgaaaggggttattatattgattattttgttcggggtttttattttttgttgggttttttttgtgttttatgtttttttgatgatattttgtttaagtaatttttattgcgtttgttatatgttttttttttaggtgaacggtatgttgattatgtgtaatgtcgttattgatttttttatatatgtttttcggagtttagagtttagggacgtatttaaaaagatgattttttgtagtaggt

SEQ ID NO: 235 - DNA, 507 bp, Artificial Sequence
  NCL amplicon
aagttgtgtttttaaaagggttaacgggaatttcgcggtttttgaattttcggtgttggcggatttttcgttttagggttattaggagtcgcggcgtgagtgcgtgtcgggatcgagcgcggggtttttgaggaattttaaggttgtttaagtttacggatttagttatattggcgaatcggagatcgttcgattttattattttcgcgttttttttatagtcggcgttaaaaacgttagttttacgacgtaggtcgggattcgcgcgtttacggtttaattagcgcggattttgtataaagcgagtttcgtttttacggcgtcgttgttagtttttttttttttcgtggtcgtttcggttcgtttatttttcgtttcgcgtcgtttacggttagaggttcgcgattggtttatggggacggtcgcgagttttggttggtcggcgcggagttacgagggcgtcgtcgtcgtttttttataggcgattattgggtaggtttagttttt

SEQ ID NO: 236 - DNA, 473 bp, Artificial Sequence
  POMC amplicon
agtttttaaataatggggaaatcggaggttttttcgtgtgtagacggtgatatttatcgttaaatgcgaattaggtagatgttagttttagtacgtacgtaggtaattttattttcgttttaacgattttagaggttgttcggtttgttttatacgggggtgttaagtttttcgttcgttttaagcggagatttaacgttatttataattaagttttttttgagggcgagcggttaggtgcgttttcggtaggatagtgttaattttagtttttttttagcgcgttttttcgcgttcgtttttcgtttggaagttttttttttacgtttcgcggtttttttttttttggttcggggagttgttttttgtgttgtcgggaaggttaaagtttcgcgtttattaggagagttcggtaagtatataaggatagaggagcgcgggattaagcggcggcgaaggaggggaagaagagt

SEQ ID NO: 237 - DNA, 534 bp, Artificial Sequence
  TGFA amplicon
ggtttgtttgggaggtaaggcggtaggcgttgttagaattgatgggaattgtggtataggtgggaaatttggtttaataaattttttattgatttaggggattattttttttgagttaagttttggtaagcggtcggcgaaatttataggttttttttttggttgcgtttttagtttttagtttttttcgttttagagatgttttaggagcggtttttcggtgtaggtaacgggtgttcgggcggtttcgtttcgtcgtttagagtttggaagtcgttattgcggtttaggataattcggttacgcggtcggcgtcgatttcgtacgttggagttcgttgtcgtacggcgttggtagtcgggggtggtgtttgaagttaggcgttttttgttttttcgtcggttcgggtgttcggttcgcgtcgttaggttttgggattttaggtcgtttcgtttagtagttcgcgttttgttcggtgcgtttagcgttttcgttttttattttaaatttttattttttgtgtttttagggggg

SEQ ID NO: 238 - DNA, 461 bp, Artificial Sequence
  Truncated POMC amplicon
agtttttaaataatggggaaatcggaggttttttcgtgtgtagacggtgatatttatcgttaaatgcgaattaggtagatgttagttttagtacgtacgtaggtaattttattttcgttttaacgattttagaggttgttcggtttgttttatacgggggtgttaagtttttcgttcgttttaagcggagatttaacgttatttataattaagttttttttgagggcgagcggttaggtgcgttttcggtaggatagtgttaattttagtttttttttagcgcgttttttcgcgttcgtttttcgtttggaagttttttttttacgtttcgcggtttttttttttttggttcggggagttgttttttgtgttgtcgggaaggttaaagtttcgcgtttattaggagagttcggtaagtatataaggatagaggagcgcgggattaagcggcggcgaaggag

SEQ ID NO: 239 - DNA, 4916 bp, Artificial Sequence
  Truncated POMC
agtttggataagatagcgagatttcgttttaaaaaaaaaaaaaaaaaaaagtataggaatgaggtattggagttagtagttgtagttttttaagagttaagttttttgtattggaggatatttagtgtatatgtgttattgatggttatggtttgagtaggtagtttgagttttttaggttgttttgagggtttttgttgatgcgagtttttattgaaaagtttagttgaggatattgtgttgaggaggttgtgggagggaggaagtatcgagtcgggtatgggagttttttcgttgtttgtgagttttttttttttgttgaattagtttttatttgattttttttaatcgttaggtgatagagattaggaagaaagaggttttatatatgtttttcgaggatgtgtttgtggagaggtttaggtgaggagaggacgggggacgtggttagggatttttagggtagttgagtaagtaggtgggtggtttgaggttaggaggggttaatgttaggaggtttagatttttgtggatttaagggtagaaggtgggttttgttgtggtttaggagttttgggtaaagtttaattttattatattattgtagtttatgtttcgagtatgtaatgttgagttatgtttgtagatgagatatagttttcgggggttttggttaagtttatgttaaatgtattttggaggagttatttttgataagatattattgtaaatttaagtaatgttttcggattatagtgggtgttgtgggttagtgttattttaatattagaggaatttaagggaaagatgttttgtaaaattaaaatgtttaatagtaggggatggttttataaattatggtttatttatatagtagataattatgataatgttttagaagaatatttaatgtaaaatatttattatataaataggttaataaaatagattatagaatagcgggtggggaaggggatatttgtgtatatttaaaaatacgggattaagttgggtgcggtggtttacgtttgtaggtttagcgatttagaagattgagtaggaggattttttgagtttatgagttcgagataattatgggtcgtaaagtaagaatttatttttataaaaaatgtttaaaaattttgttcgggttggtatagtgatttacgtttgtaattttagtattttgggaggttaaggtgggcggattatttgaggttagaagttcgagattattttggttaatatggtgaaattttatttttattaaaaatataaaaattagttaggtatggtggcgtatatttgtagttttagttattttattcgggaggttgaggtaggagaatttgtttgaatttaggaggtaaaggttgtagtgagtcgagattatgttattgtattttagtttgggtaatagagtaagattttgtttaaaaaaaaaaaaaaaaaattaggtcggttatagtggtttatgtttatgtaattttagtattagtattttgggtggttgaggcgggtagattatttgagattaggagttggagattagtttggttaatatagtaaaattttgtttttattaaaaatataaaaattagttaggtgtggtggcgtgcgtatgtaattttagttatttgggaggttgaggtaggagaatcgtttgaatttgggaggtagaggttgtagtgagttgagattatgttattgtattttagtttgggtaatagggagagatttggtttaagaaataattataataataaataaataaataaataaaattagttaggtatggtggagcgtatttgttgggaggtagagtaggaagattattttagtttggtaggttaaggttgtagtgtgttatgatggtgtttgtgaatagttattgtattttagtttgggaaatatagtgaggattttgtttttaaaaaataaaaagggggagggaagatggatttttaatttgttttatgagaatagtataattttttgatatttaaattagataagaattttataagaaaggaaaattataggtttattttatgaatattaatgtaaatgttttaaataaaatattagtaaattgagtttagtgttttttgtataaggataatatattataattaaattgggtttaatttaagaagttatggtaggtttaatattaaaaaattaataatgtaataatttattatattattagaataaaggtgaaaaattatgttatgttagataattaaaggtatttgttttaggtttttaaagaggagttagtggtataaggatgtaagggtagtggtgatttttttttagtggtattagttgaagtgagaatggtagcgttttattttggggatagaagtgacgtttatgttagacgtttgtggttttgatatgttttttgtggttttttgtggtttgttttttttttttttattggatgtgattttggttatggttttagttatattgtgtttttgtttatttttagattttggttttttaatttgtttagtgatttttttttttttttagatggagttttgttgtgtcgttaggttggagtgtagtggcgcgatttcggtttatcgtaattttcgttttttaggtttaagcgatttttttgttttagttattcgagtagttgggattataggtgtgcgttattacgttcggttaatttttgtatttttagtagagacggggtttcgttattttggttaggaatgtttttattttttgatttcgtgatttgtttaatttagttttttagagtgttgggattataggcgtgagttattgtgtttcgtttatttagtgattttaaatgtagtttaatggttttttagtttatggaggttaaagtaggttttgttgtattaaattaagaaattgggttgggtgtggtggttaatatttgtaattttagtattttaggatattgatgtggattatttgagtttaggagtttgagattagtttaggtaatatagtgaaattttgtttttattaaaaataaaaataaaaataaaataaaaaattaaaatttaaaattagttgggtatggtggtatgtatttgtggttttaggtatttaggaggttgaagtatgaggattatttgagtttaggaggtggaggttgtagtgagtagtgtttatattgttgtattttagtttgggtaatagagtgagattttaatttaaaaataaataaatagaatgagagagagagagaagaaaagaaagaaggaatttagttaaagaagttgggtttatttggattttttttggtttgttttatttgttgttattagtagttttttgaagttataaaaataatataaagtaaaataaggtaaaattattatttgtttgaaagagtttataaatttgatggtggtcgtggggtggatggaagattaaaaaaatggggatagaagtgaattagtgtaagttatttgtattgataagatggggatggatttttgtggaaggtagaggaggttatgttttatgtttttggtaggaaaagtggttaaagagggttttagagaataggggttgatggatgggttatattttgatgtgagttaagtttttggatggttggagagaggaaggatgttttagttgggggaatagtttggataatggagatttaagaaagttatgttttagtagtgtgaatgttgtggatgttgaagtgttaggatgtaaggtggagaattgggaaatggttttggaaaggggcgaaagtcgggtgatgaagtattttgtttattgtgacggagtttggattttttttgtggtttaaagggaaaggattgttgaatgtaaagttaatgttattagaaaagttgaatttataagagagttttggagtttaaaagagtattttatggggaattaggaaagttttggtatttggtagattaagtaagtgttttgatttgaagtttagtttagttttaatatttttttttatatttattatatcgtataatttggttttgtttatttattttaggttaaggtagagttttttagtttggtttgagtgttgtatttttttttttggtttgatatttggaattaaagttaagttagaattttagggttaagggggatgttgaaaattgtttgagtttttagattattttgttagtttatggtaaagggagggattagaggttatagggaaagtattttagttgttttttatagtattattttttttttatttaatggtttaggttaataggattttttttttgaggtttgggatacggaagggagttttttttaaattaggtttttggagagtaggttttaggggagtagtgtaatttatttttatatttataagacggtttttgatttttgttttttttttttttttttaaagtggaatagagagaatatgattttttacgatttttatattatagtttttaaataatggggaaatcggaggttttttcgtgtgtagacggtgatatttatcgttaaatgcgaattaggtagatgttagttttagtacgtacgtaggtaattttattttcgttttaacgattttagaggttgttcggtttgttttatacgggggtgttaagtttttcgttcgttttaagcggagatttaacgttatttataattaagttttttttgagggcgagcggttaggtgcgttttcggtaggatagtgttaattttagtttttttttagcgcgttttttcgcgttcgtttttcgtttggaagttttttttttacgtttcgcggtttttttttttttggttcggggagttgttttttgtgttgtcgggaaggttaaagtttcgcgtttattaggagagttcggtaagtatataaggatagaggagcgcgggattaagcggcggcgaaggag

What is claimed is:

1. An isolated nucleic acid consisting of at least 100 contiguous nucleotides of a chemically pretreated genomic DNA sequence from nucleotides 4456-4928 of SEQ ID NO: 37 or the corresponding portion of SEQ ID NO: 38.

2. The nucleic acid of claim 1, wherein the contiguous base sequence comprises at least one CpG dinucleotide.

3. The nucleic acid of claim 2, wherein the cytosine of the CpG dinucleotide is located approximately in the middle third of the contiguous base sequence.

4. A set of oligomers, comprising at least two nucleic acid oligomers according to any one of claims 1 to 3.

5. A set of oligomers according to claim 4, comprising oligomers for detecting the methylation state of all CpG dinucleotides within the genomic region corresponding to nucleotides 4456 through 4928 of SEQ ID NO:37 or the corresponding portion of SEQ ID NO:38.

6. A set of at least two oligomers, according to claim 4, which can be used as primer oligonucleotides for the amplification of nucleotides 4456 through 4928 of SEQ ID NO:37, the corresponding portion of SEQ ID NO:38, or contiguous portions thereof.

7. The set of oligomers of claim 6, wherein at least one oligonucleotide is bound to a solid phase.

8. A method for manufacturing an arrangement of different nucleic acid oligomers, comprising:

obtaining at least one oligomer according to any one of claims 1 to 3; and coupling the at least one oligomer to a carrier material.

9. An arrangement of different oligomers, comprising at least one oligomer according to any one of claims 1 to 3 coupled to a carrier material.

10. The arrangement of claim 9, wherein the oligomers are arranged on a solid phase in the form of a rectangular or hexagonal lattice.

11. The arrangement according to claim 9, wherein the carrier material comprises a solid phase comprising a material selected from the group consisting of silicon, glass, polystyrene, aluminium, steel, iron, copper, nickel, silver, gold, and combinations thereof.

12. A kit, comprising: a bisulfite reagent; and at least one oligomer according to claim 1.

13. The kit of claim 12, further comprising standard methylation assay reagents for performing a methylation assay selected from the group consisting of MS-SNuPE, COBRA, array-based assays, and combinations thereof.

14. A nucleic acid away having utility for analysing prostate cell proliferative disorders, comprising at least one nucleic acid according to any one of claims 1 to 3.

15. The nucleic acid of claim 1, comprising at least one of an oligonucleotide, and a peptide nucleic acid (PNA)-oligomer.

16. The arrangement of claim 9, wherein the at least one oligomer is a peptide nucleic acid (PNA)-oligomer.

* * * * *